United States Patent
Liu et al.

(10) Patent No.: US 10,113,163 B2
(45) Date of Patent: Oct. 30, 2018

(54) ADENOSINE NUCLEOBASE EDITORS AND USES THEREOF

(71) Applicant: President and Fellows of Harvard College, Cambridge, MA (US)

(72) Inventors: David R. Liu, Lexington, MA (US); Nicole Gaudelli, Belmont, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

(21) Appl. No.: 15/791,085

(22) Filed: Oct. 23, 2017

(65) Prior Publication Data

US 2018/0073012 A1  Mar. 15, 2018

Related U.S. Application Data

(63) Continuation of application No. PCT/US2017/045381, filed on Aug. 3, 2017.

(60) Provisional application No. 62/473,714, filed on Mar. 20, 2017, provisional application No. 62/454,035, filed on Feb. 2, 2017, provisional application No. 62/370,684, filed on Aug. 3, 2016.

(51) Int. Cl.
| | | |
|---|---|---|
| *C12N 15/10* | (2006.01) | |
| *C12N 9/22* | (2006.01) | |
| *C12N 9/78* | (2006.01) | |

(52) U.S. Cl.
CPC ........... *C12N 15/1024* (2013.01); *C12N 9/22* (2013.01); *C12N 9/78* (2013.01); *C12Y 305/04004* (2013.01)

(58) Field of Classification Search
None
See application file for complete search history.

(56) References Cited

U.S. PATENT DOCUMENTS

| | | | |
|---|---|---|---|
| 4,235,871 A | 11/1980 | Papahadjopoulos et al. | |
| 4,501,728 A | 2/1985 | Geho et al. | |
| 4,737,323 A | 4/1988 | Martin et al. | |
| 4,837,028 A | 6/1989 | Allen | |
| 4,880,635 A | 11/1989 | Janoff et al. | |
| 4,906,477 A | 3/1990 | Kurono et al. | |
| 4,911,928 A | 3/1990 | Wallach | |
| 4,917,951 A | 4/1990 | Wallach | |
| 4,920,016 A | 4/1990 | Allen et al. | |
| 4,921,757 A | 5/1990 | Wheatley et al. | |
| 5,139,941 A | 8/1992 | Muzyczka et al. | |
| 5,580,737 A | 12/1996 | Polisky et al. | |
| 5,767,099 A | 6/1998 | Harris et al. | |
| 5,780,053 A | 7/1998 | Ashley et al. | |
| 5,830,430 A | 11/1998 | Unger et al. | |
| 5,851,548 A | 12/1998 | Dattagupta et al. | |
| 5,855,910 A | 1/1999 | Ashley et al. | |
| 5,962,313 A | 10/1999 | Podsakoff et al. | |
| 6,057,153 A | 5/2000 | George et al. | |
| 6,453,242 B1 | 9/2002 | Eisenberg et al. | |
| 6,503,717 B2 | 1/2003 | Case et al. | |
| 6,534,261 B1 | 3/2003 | Cox, III et al. | |
| 6,599,692 B1 | 7/2003 | Case et al. | |
| 6,607,882 B1 | 8/2003 | Cox, III et al. | |
| 6,824,978 B1 | 11/2004 | Cox, III et al. | |
| 6,933,113 B2 | 8/2005 | Case et al. | |
| 6,979,539 B2 | 12/2005 | Cox, III et al. | |
| 7,013,219 B2 | 3/2006 | Case et al. | |
| 7,163,824 B2 | 1/2007 | Cox, III et al. | |
| 7,479,573 B2 | 1/2009 | Chu et al. | |
| 7,794,931 B2 | 9/2010 | Breaker et al. | |
| 7,919,277 B2 | 4/2011 | Russell et al. | |
| 7,993,672 B2 | 8/2011 | Huang et al. | |
| 8,361,725 B2 | 1/2013 | Russell et al. | |
| 8,394,604 B2 | 3/2013 | Liu et al. | |
| 8,492,082 B2 | 7/2013 | De Franciscis et al. | |
| 8,546,553 B2 | 10/2013 | Terns et al. | |
| 8,569,256 B2 | 10/2013 | Heyes et al. | |
| 8,680,069 B2 | 3/2014 | de Fougerolles et al. | |
| 8,691,750 B2 | 4/2014 | Constien et al. | |
| 8,697,359 B1 | 4/2014 | Zhang | |
| 8,709,466 B2 | 4/2014 | Coady et al. | |
| 8,728,526 B2 | 5/2014 | Heller | |
| 8,748,667 B2 | 6/2014 | Budzik et al. | |
| 8,758,810 B2 | 6/2014 | Okada et al. | |
| 8,759,103 B2 | 6/2014 | Kim et al. | |
| 8,759,104 B2 | 6/2014 | Unciti-Broceta et al. | |
| 8,771,728 B2 | 7/2014 | Huang et al. | |
| 8,790,664 B2 | 7/2014 | Pitard et al. | |
| 8,795,965 B2 | 8/2014 | Zhang | |
| 8,846,578 B2 | 9/2014 | McCray et al. | |
| 8,993,233 B2 | 3/2015 | Zhang et al. | |
| 8,999,641 B2 | 4/2015 | Zhang et al. | |
| 9,068,179 B1 | 6/2015 | Liu et al. | |
| 9,163,284 B2 | 10/2015 | Liu et al. | |
| 9,228,207 B2 | 1/2016 | Liu et al. | |
| 9,234,213 B2 | 1/2016 | Wu | |

(Continued)

FOREIGN PATENT DOCUMENTS

| | | |
|---|---|---|
| AU | 2012244264 A1 | 11/2012 |
| AU | 2015252023 A1 | 11/2015 |

(Continued)

OTHER PUBLICATIONS

Wolf J et al. TadA, an essential tRNA-specific adenosine deaminase from *Escherichia coli*. 2002. The EMBO Journal. vol. 21 No. 14. p. 3841-3851, 2002. (Year: 2002).*

(Continued)

*Primary Examiner* — Paul J Holland
(74) *Attorney, Agent, or Firm* — Wolf, Greenfield & Sacks, P.C.

(57) ABSTRACT

The disclosure provides adenosine deaminases that are capable of deaminating adenosine in DNA. The disclosure also provides fusion proteins comprising a Cas9 (e.g., a Cas9 nickase) domain and adenosine deaminases that deaminate adenosine in DNA. In some embodiments, the fusion proteins further comprise a nuclear localization sequence (NLS), and/or an inhibitor of base repair, such as, a nuclease dead inosine specific nuclease (dISN).

32 Claims, 248 Drawing Sheets

Specification includes a Sequence Listing.

(56) References Cited

U.S. PATENT DOCUMENTS

| | | |
|---|---|---|
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,512,446 B1 | 12/2016 | Joung et al. |
| 9,526,724 B2 | 12/2016 | Oshlack et al. |
| 9,737,604 B2 | 8/2017 | Liu et al. |
| 9,816,093 B1 | 11/2017 | Donohoue et al. |
| 9,840,699 B2 | 12/2017 | Liu et al. |
| 9,873,907 B2 | 1/2018 | Zeiner et al. |
| 9,879,270 B2 | 1/2018 | Hittinger et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2006/0088864 A1 | 4/2006 | Smolke et al. |
| 2006/0246568 A1 | 11/2006 | Honjo et al. |
| 2007/0264692 A1 | 11/2007 | Liu et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0316643 A1 | 12/2010 | Eckert et al. |
| 2011/0059160 A1 | 3/2011 | Essner et al. |
| 2011/0104787 A1 | 5/2011 | Church et al. |
| 2011/0189776 A1 | 8/2011 | Terns et al. |
| 2011/0217739 A1 | 9/2011 | Terns et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0186843 A1 | 7/2014 | Zhang et al. |
| 2014/0186958 A1 | 7/2014 | Zhang et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1* | 6/2015 | Liu ................. C12Y 304/2206 424/94.3 |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0315252 A1 | 11/2015 | Haugwitz et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0138046 A1 | 5/2016 | Wu |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |

(56) References Cited

U.S. PATENT DOCUMENTS

| | | | |
|---|---|---|---|
| 2017/0058271 | A1 | 3/2017 | Joung et al. |
| 2017/0058272 | A1 | 3/2017 | Carter et al. |
| 2017/0058298 | A1 | 3/2017 | Kennedy et al. |
| 2017/0073663 | A1 | 3/2017 | Wang et al. |
| 2017/0087224 | A1 | 3/2017 | Quake |
| 2017/0087225 | A1 | 3/2017 | Quake |
| 2017/0088587 | A1 | 3/2017 | Quake |
| 2017/0088828 | A1 | 3/2017 | Quake |
| 2017/0107560 | A1 | 4/2017 | Peter et al. |
| 2017/0114367 | A1 | 4/2017 | Hu et al. |
| 2017/0121693 | A1 | 5/2017 | Liu et al. |
| 2017/0145394 | A1 | 5/2017 | Yeo et al. |
| 2017/0145405 | A1 | 5/2017 | Tang et al. |
| 2017/0145438 | A1 | 5/2017 | Kantor |
| 2017/0152787 | A1 | 6/2017 | Kubo et al. |
| 2017/0159033 | A1 | 6/2017 | Kamtekar et al. |
| 2017/0166928 | A1 | 6/2017 | Vyas et al. |
| 2017/0175104 | A1 | 6/2017 | Doudna et al. |
| 2017/0191047 | A1 | 7/2017 | Terns et al. |
| 2017/0198277 | A1 | 7/2017 | Kmiec et al. |
| 2017/0198302 | A1 | 7/2017 | Feng et al. |
| 2017/0226522 | A1 | 8/2017 | Hu et al. |
| 2017/0233703 | A1 | 8/2017 | Xie et al. |
| 2017/0233756 | A1 | 8/2017 | Begemann et al. |
| 2017/0247671 | A1 | 8/2017 | Yung et al. |
| 2017/0247703 | A1 | 8/2017 | Sloan et al. |
| 2017/0268022 | A1 | 9/2017 | Liu et al. |
| 2017/0283797 | A1 | 10/2017 | Robb et al. |
| 2017/0314016 | A1 | 11/2017 | Kim et al. |
| 2017/0362635 | A1 | 12/2017 | Chamberlain et al. |
| 2018/0064077 | A1 | 3/2018 | Dunham et al. |
| 2018/0066258 | A1 | 3/2018 | Powell |
| 2018/0068062 | A1 | 3/2018 | Zhang et al. |
| 2018/0073012 | A1 | 3/2018 | Liu et al. |
| 2018/0100147 | A1 | 4/2018 | Yates et al. |
| 2018/0105867 | A1 | 4/2018 | Xiao et al. |

FOREIGN PATENT DOCUMENTS

| | | | |
|---|---|---|---|
| AU | 2015101792 | A4 | 1/2016 |
| CA | 2 852 593 | A1 | 11/2015 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 103911376 | A | 7/2014 |
| CN | 103923911 | A | 7/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 104404036 | A | 3/2015 |
| CN | 104450774 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039339 | A | 11/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105132427 | A | 12/2015 |
| CN | 105132451 | A | 12/2015 |
| CN | 105177038 | A | 12/2015 |
| CN | 105177126 | A | 12/2015 |
| CN | 105210981 | A | 1/2016 |
| CN | 105219799 | A | 1/2016 |
| CN | 105238806 | A | 1/2016 |
| CN | 105255937 | A | 1/2016 |
| CN | 105274144 | A | 1/2016 |
| CN | 105296518 | A | 2/2016 |
| CN | 105296537 | A | 2/2016 |
| CN | 105316324 | A | 2/2016 |
| CN | 105316327 | A | 2/2016 |
| CN | 105316337 | A | 2/2016 |
| CN | 105331607 | A | 2/2016 |
| CN | 105331608 | A | 2/2016 |
| CN | 105331609 | A | 2/2016 |
| CN | 105331627 | A | 2/2016 |
| CN | 105400773 | A | 3/2016 |
| CN | 105400779 | A | 3/2016 |
| CN | 105400810 | A | 3/2016 |
| CN | 105441451 | A | 3/2016 |
| CN | 105462968 | A | 4/2016 |
| CN | 105463003 | A | 4/2016 |
| CN | 105463027 | A | 4/2016 |
| CN | 105492608 | A | 4/2016 |
| CN | 105492609 | A | 4/2016 |
| CN | 105505976 | A | 4/2016 |
| CN | 105505979 | A | 4/2016 |
| CN | 105518134 | A | 4/2016 |
| CN | 105518135 | A | 4/2016 |
| CN | 105518137 | A | 4/2016 |
| CN | 105518138 | A | 4/2016 |
| CN | 105518139 | A | 4/2016 |
| CN | 105518140 | A | 4/2016 |
| CN | 105543228 | A | 5/2016 |
| CN | 105543266 | A | 5/2016 |
| CN | 105543270 | A | 5/2016 |
| CN | 105567688 | A | 5/2016 |
| CN | 105567689 | A | 5/2016 |
| CN | 105567734 | A | 5/2016 |
| CN | 105567735 | A | 5/2016 |
| CN | 105567738 | A | 5/2016 |
| CN | 105593367 | A | 5/2016 |
| CN | 105594664 | A | 5/2016 |
| CN | 105602987 | A | 5/2016 |
| CN | 105624146 | A | 6/2016 |
| CN | 105624187 | A | 6/2016 |
| CN | 105646719 | A | 6/2016 |
| CN | 105647922 | A | 6/2016 |
| CN | 105647962 | A | 6/2016 |
| CN | 105647968 | A | 6/2016 |
| CN | 105647969 | A | 6/2016 |
| CN | 105671070 | A | 6/2016 |
| CN | 105671083 | A | 6/2016 |
| CN | 105695485 | A | 6/2016 |
| CN | 105779448 | A | 7/2016 |
| CN | 105779449 | A | 7/2016 |
| CN | 105802980 | A | 7/2016 |
| CN | 105821039 | A | 8/2016 |
| CN | 105821040 | A | 8/2016 |

(56) References Cited

FOREIGN PATENT DOCUMENTS

| | | |
|---|---|---|
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177631 A | 9/2017 |
| CN | 107190006 A | 9/2017 |

(56) References Cited

FOREIGN PATENT DOCUMENTS

| | | |
|---|---|---|
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |
| CN | 107586777 | 1/2018 |
| CN | 107586779 | 1/2018 |
| CN | 107604003 | 1/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| EP | 2 604 255 A1 | 6/2013 |
| EP | 2 966 170 A1 | 1/2016 |
| EP | 3 009 511 A2 | 4/2016 |
| EP | 3199632 A1 | 8/2017 |
| GB | 2 528 177 A | 1/2016 |
| GB | 2 531 454 A1 | 4/2016 |
| GB | 2542653 A | 3/2017 |
| JP | 2007-501626 A | 2/2007 |
| JP | 2010-539929 A | 12/2010 |
| KR | 101584933 B1 | 1/2016 |
| KR | 20160133380 A | 11/2016 |
| KR | 20170037025 A | 4/2017 |
| KR | 20170037028 A | 4/2017 |
| KR | 101748575 B1 | 6/2017 |
| RU | 2016104674 A | 8/2017 |
| RU | 2634395 C1 | 10/2017 |
| WO | WO-2001/38547 A2 | 5/2001 |
| WO | WO-2002/059296 A2 | 8/2002 |
| WO | WO-2002/068676 A2 | 9/2002 |
| WO | WO-2002/103028 A2 | 12/2002 |
| WO | WO-2004/007684 A2 | 1/2004 |
| WO | WO-2005/014791 A2 | 2/2005 |
| WO | WO-2006/002547 A1 | 1/2006 |
| WO | WO-2006/042112 A2 | 4/2006 |
| WO | WO-2007/025097 A2 | 3/2007 |
| WO | WO-2007/136815 A2 | 11/2007 |
| WO | WO-2007/143574 A1 | 12/2007 |
| WO | WO-2008/108989 A2 | 9/2008 |
| WO | WO-2009/134808 A2 | 11/2009 |
| WO | WO-2010/011961 A2 | 1/2010 |
| WO | WO-2010/054108 A2 | 5/2010 |
| WO | WO-2010/054154 A2 | 5/2010 |
| WO | WO-2010/068289 A2 | 6/2010 |
| WO | WO-2010/075424 A2 | 7/2010 |
| WO | WO-2010/102257 A2 | 9/2010 |
| WO | WO-2010/129019 A2 | 11/2010 |
| WO | WO-2010/129023 A2 | 11/2010 |
| WO | WO-2010/132092 A2 | 11/2010 |
| WO | WO-2010/144150 A2 | 12/2010 |
| WO | WO-2011/002503 A1 | 1/2011 |
| WO | WO-2011/017293 A2 | 2/2011 |
| WO | WO-2011/053868 A1 | 5/2011 |
| WO | WO-2011/053982 A2 | 5/2011 |
| WO | WO-2011/075627 A1 | 6/2011 |
| WO | WO-2011/091311 A2 | 7/2011 |
| WO | WO-2011/109031 A1 | 9/2011 |
| WO | WO-2011/143124 A2 | 11/2011 |
| WO | WO-2012/054726 A1 | 4/2012 |
| WO | WO-2012/065043 A2 | 5/2012 |
| WO | WO-2012/125445 A2 | 9/2012 |
| WO | WO-2012/138927 A2 | 10/2012 |
| WO | WO-2012/158985 A2 | 11/2012 |
| WO | WO-2012/158986 A2 | 11/2012 |
| WO | WO-2012/164565 A1 | 12/2012 |
| WO | WO-2013/012674 A1 | 1/2013 |
| WO | WO-2013/013105 A2 | 1/2013 |
| WO | WO-2013/066438 A2 | 5/2013 |
| WO | WO-2013/098244 A1 | 7/2013 |
| WO | WO-2013/119602 A1 | 8/2013 |
| WO | WO-2013/126794 A1 | 8/2013 |
| WO | WO-2013/130824 A1 | 9/2013 |
| WO | WO-2013/141680 A1 | 9/2013 |
| WO | WO-2013/142578 A2 | 9/2013 |
| WO | WO-2013/160230 A1 | 10/2013 |
| WO | WO-2013/166315 A1 | 11/2013 |
| WO | WO-2013/169398 A2 | 11/2013 |

(56) References Cited

FOREIGN PATENT DOCUMENTS

| | | |
|---|---|---|
| WO | WO-2013/169802 A1 | 11/2013 |
| WO | WO-2013/176772 A2 | 11/2013 |
| WO | WO-2013/176915 A1 | 11/2013 |
| WO | WO-2013/176916 A1 | 11/2013 |
| WO | WO-2013/181440 A1 | 12/2013 |
| WO | WO-2013/186754 A2 | 12/2013 |
| WO | WO-2013/188037 A2 | 12/2013 |
| WO | WO-2013/188522 A2 | 12/2013 |
| WO | WO-2013/188638 A2 | 12/2013 |
| WO | WO-2013/192278 A1 | 12/2013 |
| WO | WO-2013/142378 A9 | 1/2014 |
| WO | WO-2014/005042 A2 | 1/2014 |
| WO | WO-2014/011237 A1 | 1/2014 |
| WO | WO-2014/011901 A2 | 1/2014 |
| WO | WO-2014/018423 A2 | 1/2014 |
| WO | WO-2014/020608 A1 | 2/2014 |
| WO | WO-2014/022120 A1 | 2/2014 |
| WO | WO-2014/022702 A2 | 2/2014 |
| WO | WO-2014/036219 A2 | 3/2014 |
| WO | WO-2014/039513 A2 | 3/2014 |
| WO | WO-2014/039523 A1 | 3/2014 |
| WO | WO-2014/039684 A1 | 3/2014 |
| WO | WO-2014/039692 A2 | 3/2014 |
| WO | WO-2014/039702 A2 | 3/2014 |
| WO | WO-2014/039872 A1 | 3/2014 |
| WO | WO-2014/039970 A1 | 3/2014 |
| WO | WO-2014/041327 A1 | 3/2014 |
| WO | WO-2014/043143 A1 | 3/2014 |
| WO | WO-2014/047103 A2 | 3/2014 |
| WO | WO-2014/059173 A2 | 4/2014 |
| WO | WO-2014/059255 A1 | 4/2014 |
| WO | WO-2014/065596 A1 | 5/2014 |
| WO | WO-2014/066505 A1 | 5/2014 |
| WO | WO-2014/068346 A2 | 5/2014 |
| WO | WO-2014/070887 A1 | 5/2014 |
| WO | WO-2014/071006 A1 | 5/2014 |
| WO | WO-2014/071219 A1 | 5/2014 |
| WO | WO-2014/071235 A1 | 5/2014 |
| WO | WO-2014/072941 A1 | 5/2014 |
| WO | WO-2014/081729 A1 | 5/2014 |
| WO | WO-2014/081730 A1 | 5/2014 |
| WO | WO-2014/081855 A1 | 5/2014 |
| WO | WO-2014/082644 A1 | 6/2014 |
| WO | WO-2014/085261 A1 | 6/2014 |
| WO | WO-2014/085593 A1 | 6/2014 |
| WO | WO-2014/085830 A2 | 6/2014 |
| WO | WO-2014/089212 A1 | 6/2014 |
| WO | WO-2014/089290 A1 | 6/2014 |
| WO | WO-2014/089348 A1 | 6/2014 |
| WO | WO-2014/089513 A1 | 6/2014 |
| WO | WO-2014/089533 A2 | 6/2014 |
| WO | WO-2014/089541 A2 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/093736 A1 | 6/2014 |
| WO | WO-2014/093768 A1 | 6/2014 |
| WO | WO-2014/093852 A1 | 6/2014 |
| WO | WO-2014/096972 A2 | 6/2014 |
| WO | WO-2014/099744 A1 | 6/2014 |
| WO | WO-2014/099750 A2 | 6/2014 |
| WO | WO-2014/104878 A1 | 7/2014 |
| WO | WO-2014/110006 A1 | 7/2014 |
| WO | WO-2014/110552 A1 | 7/2014 |
| WO | WO-2014/113493 A1 | 7/2014 |
| WO | WO-2014/123967 A2 | 8/2014 |
| WO | WO-2014/124226 A1 | 8/2014 |
| WO | WO-2014/125668 A1 | 8/2014 |
| WO | WO-2014/127287 A1 | 8/2014 |
| WO | WO-2014/128324 A1 | 8/2014 |
| WO | WO-2014/128659 A1 | 8/2014 |
| WO | WO-2014/130706 A1 | 8/2014 |
| WO | WO-2014/130955 A1 | 8/2014 |
| WO | WO-2014/131833 A1 | 9/2014 |
| WO | WO-2014/138379 A1 | 9/2014 |
| WO | WO-2014/143381 A1 | 9/2014 |
| WO | WO-2014/144094 A1 | 9/2014 |
| WO | WO-2014/144155 A1 | 9/2014 |
| WO | WO-2014/144288 A1 | 9/2014 |
| WO | WO-2014/144592 A2 | 9/2014 |
| WO | WO-2014/144761 A2 | 9/2014 |
| WO | WO-2014/144951 A1 | 9/2014 |
| WO | WO-2014/145599 A2 | 9/2014 |
| WO | WO-2014/145736 A2 | 9/2014 |
| WO | WO-2014/150624 A1 | 9/2014 |
| WO | WO-2014/152432 A2 | 9/2014 |
| WO | WO-2014/153118 A1 | 9/2014 |
| WO | WO-2014/153470 A2 | 9/2014 |
| WO | WO-2014/161821 A1 | 10/2014 |
| WO | WO-2014/164466 A1 | 10/2014 |
| WO | WO-2014/165177 A1 | 10/2014 |
| WO | WO-2014/165349 A1 | 10/2014 |
| WO | WO-2014/165612 A2 | 10/2014 |
| WO | WO-2014/165707 A2 | 10/2014 |
| WO | WO-2014/165825 A2 | 10/2014 |
| WO | WO-2014/172458 A1 | 10/2014 |
| WO | WO-2014/172470 A2 | 10/2014 |
| WO | WO-2014/172489 A2 | 10/2014 |
| WO | WO-2014/173955 A1 | 10/2014 |
| WO | WO-2014/182700 A1 | 11/2014 |
| WO | WO-2014/183071 A2 | 11/2014 |
| WO | WO-2014/184143 A1 | 11/2014 |
| WO | WO-2014/184741 A1 | 11/2014 |
| WO | WO-2014/184744 A1 | 11/2014 |
| WO | WO-2014/186585 A2 | 11/2014 |
| WO | WO-2014/186686 A2 | 11/2014 |
| WO | WO-2014/190181 A1 | 11/2014 |
| WO | WO-2014/191128 A1 | 12/2014 |
| WO | WO-2014/191518 A1 | 12/2014 |
| WO | WO-2014/191521 A2 | 12/2014 |
| WO | WO-2014/191525 A1 | 12/2014 |
| WO | WO-2014/191527 A1 | 12/2014 |
| WO | WO-2014/193583 A2 | 12/2014 |
| WO | WO-2014/194190 A1 | 12/2014 |
| WO | WO-2014/197568 A2 | 12/2014 |
| WO | WO-2014/199358 A1 | 12/2014 |
| WO | WO-2014/200659 A1 | 12/2014 |
| WO | WO-2014/201015 A2 | 12/2014 |
| WO | WO-2014/204578 A1 | 12/2014 |
| WO | WO-2014/204723 A1 | 12/2014 |
| WO | WO-2014/204724 A1 | 12/2014 |
| WO | WO-2014/204725 A1 | 12/2014 |
| WO | WO-2014/204726 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2014/205192 A2 | 12/2014 |
| WO | WO-2014/207043 A1 | 12/2014 |
| WO | WO-2014197748 A2 | 12/2014 |
| WO | WO-2015/002780 A1 | 1/2015 |
| WO | WO-2015/004241 A2 | 1/2015 |
| WO | WO-2015/006290 A1 | 1/2015 |
| WO | WO-2015/006294 A2 | 1/2015 |
| WO | WO-2015/006437 A1 | 1/2015 |
| WO | WO-2015/006498 A2 | 1/2015 |
| WO | WO-2015/007194 A1 | 1/2015 |
| WO | WO-2015/010114 A1 | 1/2015 |
| WO | WO-2015/011483 A1 | 1/2015 |
| WO | WO-2015/013583 A1 | 1/2015 |
| WO | WO-2015006747 A2 | 1/2015 |
| WO | WO-2015/017866 A1 | 2/2015 |
| WO | WO-2015/018503 A1 | 2/2015 |
| WO | WO-2015/021353 A1 | 2/2015 |
| WO | WO-2015/021426 A1 | 2/2015 |
| WO | WO-2015/021990 A1 | 2/2015 |
| WO | WO-2015/024017 A2 | 2/2015 |

(56) References Cited

FOREIGN PATENT DOCUMENTS

| | | |
|---|---|---|
| WO | WO-2015/024986 A1 | 2/2015 |
| WO | WO-2015/026883 A1 | 2/2015 |
| WO | WO-2015/026885 A1 | 2/2015 |
| WO | WO-2015/026886 A1 | 2/2015 |
| WO | WO-2015/026887 A1 | 2/2015 |
| WO | WO-2015/027134 A1 | 2/2015 |
| WO | WO-2015/028969 A2 | 3/2015 |
| WO | WO-2015/030881 A1 | 3/2015 |
| WO | WO-2015/031619 A1 | 3/2015 |
| WO | WO-2015/031775 A1 | 3/2015 |
| WO | WO-2015/032494 A2 | 3/2015 |
| WO | WO-2015/033293 A1 | 3/2015 |
| WO | WO-2015/034872 A2 | 3/2015 |
| WO | WO-2015/034885 A1 | 3/2015 |
| WO | WO-2015/035136 A2 | 3/2015 |
| WO | WO-2015/035139 A2 | 3/2015 |
| WO | WO-2015/035162 A2 | 3/2015 |
| WO | WO-2015/040075 A1 | 3/2015 |
| WO | WO-2015/040402 A1 | 3/2015 |
| WO | WO-2015/042585 A1 | 3/2015 |
| WO | WO-2015/048577 A2 | 4/2015 |
| WO | WO-2015/048690 A1 | 4/2015 |
| WO | WO-2015/048707 A2 | 4/2015 |
| WO | WO-2015/048801 A2 | 4/2015 |
| WO | WO-2015/049897 A1 | 4/2015 |
| WO | WO-2015/051191 A1 | 4/2015 |
| WO | WO-2015/052133 A1 | 4/2015 |
| WO | WO-2015/052231 A2 | 4/2015 |
| WO | WO-2015/052335 A1 | 4/2015 |
| WO | WO-2015/053995 A1 | 4/2015 |
| WO | WO-2015/054253 A1 | 4/2015 |
| WO | WO-2015/054315 A1 | 4/2015 |
| WO | WO-2015/057671 A1 | 4/2015 |
| WO | WO-2015/057834 A1 | 4/2015 |
| WO | WO-2015/057852 A1 | 4/2015 |
| WO | WO-2015/057976 A1 | 4/2015 |
| WO | WO-2015/057980 A1 | 4/2015 |
| WO | WO-2015/059265 A1 | 4/2015 |
| WO | WO-2015/065964 A1 | 5/2015 |
| WO | WO-2015/066119 A1 | 5/2015 |
| WO | WO-2015/066634 A2 | 5/2015 |
| WO | WO-2015/066636 A2 | 5/2015 |
| WO | WO-2015/066637 A1 | 5/2015 |
| WO | WO-2015/066638 A2 | 5/2015 |
| WO | WO-2015/066643 A1 | 5/2015 |
| WO | WO-2015/069682 A2 | 5/2015 |
| WO | WO-2015/070083 A1 | 5/2015 |
| WO | WO-2015/070193 A1 | 5/2015 |
| WO | WO-2015/070212 A1 | 5/2015 |
| WO | WO-2015/071474 A2 | 5/2015 |
| WO | WO-2015/073683 A2 | 5/2015 |
| WO | WO-2015/073867 A1 | 5/2015 |
| WO | WO-2015/073990 A1 | 5/2015 |
| WO | WO-2015/075056 A1 | 5/2015 |
| WO | WO-2015/075154 A2 | 5/2015 |
| WO | WO-2015/075175 A1 | 5/2015 |
| WO | WO-2015/075195 A1 | 5/2015 |
| WO | WO-2015/075557 A2 | 5/2015 |
| WO | WO-2015/077058 A2 | 5/2015 |
| WO | WO-2015/077290 A2 | 5/2015 |
| WO | WO-2015/077318 A1 | 5/2015 |
| WO | WO-2015/079056 A1 | 6/2015 |
| WO | WO-2015/079057 A2 | 6/2015 |
| WO | WO-2015/086795 A2 | 6/2015 |
| WO | WO-2015/086798 A1 | 6/2015 |
| WO | WO-2015/088643 A1 | 6/2015 |
| WO | WO-2015/089046 A1 | 6/2015 |
| WO | WO-2015/089077 A2 | 6/2015 |
| WO | WO-2015/089277 A1 | 6/2015 |
| WO | WO-2015/089351 A1 | 6/2015 |
| WO | WO-2015/089354 A1 | 6/2015 |
| WO | WO-2015/089364 A1 | 6/2015 |
| WO | WO-2015/089406 A1 | 6/2015 |
| WO | WO-2015/089419 A2 | 6/2015 |
| WO | WO-2015/089427 A1 | 6/2015 |
| WO | WO-2015/089462 A1 | 6/2015 |
| WO | WO-2015/089465 A1 | 6/2015 |
| WO | WO-2015/089473 A1 | 6/2015 |
| WO | WO-2015/089486 A2 | 6/2015 |
| WO | WO-2015/095804 A1 | 6/2015 |
| WO | WO-2015/099850 A1 | 7/2015 |
| WO | WO-2015/100929 A1 | 7/2015 |
| WO | WO-2015/103057 A1 | 7/2015 |
| WO | WO-2015/103153 A1 | 7/2015 |
| WO | WO-2015/105928 A1 | 7/2015 |
| WO | WO-2015/108993 A1 | 7/2015 |
| WO | WO-2015/109752 A1 | 7/2015 |
| WO | WO-2015/110474 A1 | 7/2015 |
| WO | WO-2015/112790 A2 | 7/2015 |
| WO | WO-2015/112896 A2 | 7/2015 |
| WO | WO-2015/113063 A1 | 7/2015 |
| WO | WO-2015/114365 A1 | 8/2015 |
| WO | WO-2015/115903 A1 | 8/2015 |
| WO | WO-2015/116686 A1 | 8/2015 |
| WO | WO-2015/116969 A2 | 8/2015 |
| WO | WO-2015/117021 A1 | 8/2015 |
| WO | WO-2015/117041 A1 | 8/2015 |
| WO | WO-2015/117081 A2 | 8/2015 |
| WO | WO-2015/118156 A1 | 8/2015 |
| WO | WO-2015/119941 A2 | 8/2015 |
| WO | WO-2015/121454 A1 | 8/2015 |
| WO | WO-2015/122967 A1 | 8/2015 |
| WO | WO-2015/123339 A1 | 8/2015 |
| WO | WO-2015/124715 A1 | 8/2015 |
| WO | WO-2015/124718 A1 | 8/2015 |
| WO | WO-2015/126927 A2 | 8/2015 |
| WO | WO-2015/127428 A1 | 8/2015 |
| WO | WO-2015/127439 A1 | 8/2015 |
| WO | WO-2015/129686 A1 | 9/2015 |
| WO | WO-2015/131101 A1 | 9/2015 |
| WO | WO-2015/133554 A1 | 9/2015 |
| WO | WO-2015/134812 A1 | 9/2015 |
| WO | WO-2015/136001 A1 | 9/2015 |
| WO | WO-2015/138510 A1 | 9/2015 |
| WO | WO-2015/138739 A2 | 9/2015 |
| WO | WO-2015/138855 A1 | 9/2015 |
| WO | WO-2015/138870 A2 | 9/2015 |
| WO | WO-2015/139008 A1 | 9/2015 |
| WO | WO-2015/139139 A1 | 9/2015 |
| WO | WO-2015/143046 A2 | 9/2015 |
| WO | WO-2015/143177 A1 | 9/2015 |
| WO | WO-2015/145417 A1 | 10/2015 |
| WO | WO-2015/148431 A1 | 10/2015 |
| WO | WO-2015/148670 A1 | 10/2015 |
| WO | WO-2015/148680 A1 | 10/2015 |
| WO | WO-2015/148761 A1 | 10/2015 |
| WO | WO-2015/148860 A1 | 10/2015 |
| WO | WO-2015/148863 A2 | 10/2015 |
| WO | WO-2015/153760 A2 | 10/2015 |
| WO | WO-2015/153780 A1 | 10/2015 |
| WO | WO-2015/153789 A1 | 10/2015 |
| WO | WO-2015/153791 A1 | 10/2015 |
| WO | WO-2015/153889 A2 | 10/2015 |
| WO | WO-2015/153940 A1 | 10/2015 |
| WO | WO-2015/155341 A1 | 10/2015 |
| WO | WO-2015/155686 A2 | 10/2015 |
| WO | WO-2015/157070 A2 | 10/2015 |
| WO | WO-2015/157534 A1 | 10/2015 |
| WO | WO-2015/159068 A1 | 10/2015 |
| WO | WO-2015/159086 A1 | 10/2015 |
| WO | WO-2015/159087 A1 | 10/2015 |
| WO | WO-2015/160683 A1 | 10/2015 |
| WO | WO-2015/161276 A2 | 10/2015 |
| WO | WO-2015/163733 A1 | 10/2015 |
| WO | WO-2015/164740 A1 | 10/2015 |
| WO | WO-2015/164748 A1 | 10/2015 |
| WO | WO-2015/165274 A1 | 11/2015 |
| WO | WO-2015/165275 A1 | 11/2015 |
| WO | WO-2015/165276 A1 | 11/2015 |
| WO | WO-2015/166272 A2 | 11/2015 |
| WO | WO-2015/167766 A1 | 11/2015 |
| WO | WO-2015/167956 A1 | 11/2015 |
| WO | WO-2015/168125 A1 | 11/2015 |
| WO | WO-2015/168158 A1 | 11/2015 |

(56) References Cited

FOREIGN PATENT DOCUMENTS

| | | |
|---|---|---|
| WO | WO-2015/168404 A1 | 11/2015 |
| WO | WO-2015/168547 A2 | 11/2015 |
| WO | WO-2015/168800 A1 | 11/2015 |
| WO | WO-2015/171603 A1 | 11/2015 |
| WO | WO-2015/171894 A1 | 11/2015 |
| WO | WO-2015/171932 A1 | 11/2015 |
| WO | WO-2015/172128 A1 | 11/2015 |
| WO | WO-2015/173436 A1 | 11/2015 |
| WO | WO-2015/175642 A2 | 11/2015 |
| WO | WO-2015/179540 A1 | 11/2015 |
| WO | WO-2015/183025 A1 | 12/2015 |
| WO | WO-2015/183026 A1 | 12/2015 |
| WO | WO-2015/183885 A1 | 12/2015 |
| WO | WO-2015/184259 A1 | 12/2015 |
| WO | WO-2015/184262 A1 | 12/2015 |
| WO | WO-2015/184268 A1 | 12/2015 |
| WO | WO-2015/188056 A1 | 12/2015 |
| WO | WO-2015/188065 A1 | 12/2015 |
| WO | WO-2015/188094 A1 | 12/2015 |
| WO | WO-2015/188109 A1 | 12/2015 |
| WO | WO-2015/188132 A1 | 12/2015 |
| WO | WO-2015/188135 A1 | 12/2015 |
| WO | WO-2015/188191 A1 | 12/2015 |
| WO | WO-2015/189693 A1 | 12/2015 |
| WO | WO-2015/191693 A2 | 12/2015 |
| WO | WO-2015/191899 A1 | 12/2015 |
| WO | WO-2015/191911 A2 | 12/2015 |
| WO | WO-2015/193858 A1 | 12/2015 |
| WO | WO-2015/195547 A1 | 12/2015 |
| WO | WO-2015/195621 A1 | 12/2015 |
| WO | WO-2015/195798 A1 | 12/2015 |
| WO | WO-2015/198020 A1 | 12/2015 |
| WO | WO-2015/200334 A1 | 12/2015 |
| WO | WO-2015/200378 A1 | 12/2015 |
| WO | WO-2015/200555 A2 | 12/2015 |
| WO | WO-2015/200805 A2 | 12/2015 |
| WO | WO-2016/001978 A1 | 1/2016 |
| WO | WO-2016/004010 A1 | 1/2016 |
| WO | WO-2016/007347 A1 | 1/2016 |
| WO | WO-2016/007604 A1 | 1/2016 |
| WO | WO-2016/007948 A1 | 1/2016 |
| WO | WO-2016/011080 A2 | 1/2016 |
| WO | WO-2016/011210 A2 | 1/2016 |
| WO | WO-2016/011428 A1 | 1/2016 |
| WO | WO-2016/012544 A2 | 1/2016 |
| WO | WO-2016/012552 A1 | 1/2016 |
| WO | WO-2016/014409 A1 | 1/2016 |
| WO | WO-2016/014565 A2 | 1/2016 |
| WO | WO-2016/014794 A1 | 1/2016 |
| WO | WO-2016/014837 A1 | 1/2016 |
| WO | WO-2016/016119 A1 | 2/2016 |
| WO | WO-2016/016358 A1 | 2/2016 |
| WO | WO-2016/019144 A2 | 2/2016 |
| WO | WO-2016/020399 A1 | 2/2016 |
| WO | WO-2016/021972 A1 | 2/2016 |
| WO | WO-2016/021973 A1 | 2/2016 |
| WO | WO-2016/022363 A2 | 2/2016 |
| WO | WO-2016/022866 A1 | 2/2016 |
| WO | WO-2016/022931 A1 | 2/2016 |
| WO | WO-2016/025131 A1 | 2/2016 |
| WO | WO-2016/025469 A1 | 2/2016 |
| WO | WO-2016/025759 A1 | 2/2016 |
| WO | WO-2016/026444 A1 | 2/2016 |
| WO | WO-2016/028682 A1 | 2/2016 |
| WO | WO-2016/028843 A1 | 2/2016 |
| WO | WO-2016/028887 A1 | 2/2016 |
| WO | WO-2016/033088 A1 | 3/2016 |
| WO | WO-2016/033230 A1 | 3/2016 |
| WO | WO-2016/033246 A1 | 3/2016 |
| WO | WO-2016/033298 A1 | 3/2016 |
| WO | WO-2016/035044 A1 | 3/2016 |
| WO | WO-2016/036754 A1 | 3/2016 |
| WO | WO-2016/037157 A2 | 3/2016 |
| WO | WO-2016/040030 A1 | 3/2016 |
| WO | WO-2016/040594 A1 | 3/2016 |
| WO | WO-2016/044182 A1 | 3/2016 |
| WO | WO-2016/044416 A1 | 3/2016 |
| WO | WO-2016/046635 A1 | 3/2016 |
| WO | WO-2016/049024 A2 | 3/2016 |
| WO | WO-2016/049163 A2 | 3/2016 |
| WO | WO-2016/049230 A1 | 3/2016 |
| WO | WO-2016/049251 A1 | 3/2016 |
| WO | WO-2016/049258 A2 | 3/2016 |
| WO | WO-2016/053397 A2 | 4/2016 |
| WO | WO-2016/054326 A1 | 4/2016 |
| WO | WO-2016/057061 A2 | 4/2016 |
| WO | WO-2016/057821 A2 | 4/2016 |
| WO | WO-2016/057835 A2 | 4/2016 |
| WO | WO-2016/057850 A2 | 4/2016 |
| WO | WO-2016/057951 A2 | 4/2016 |
| WO | WO-2016/057961 A2 | 4/2016 |
| WO | WO-2016/061073 A1 | 4/2016 |
| WO | WO-2016/061374 A1 | 4/2016 |
| WO | WO-2016/061481 A1 | 4/2016 |
| WO | WO-2016/061523 A1 | 4/2016 |
| WO | WO-2016/064894 A2 | 4/2016 |
| WO | WO-2016/069282 A1 | 5/2016 |
| WO | WO-2016/069283 A1 | 5/2016 |
| WO | WO-2016/069591 A2 | 5/2016 |
| WO | WO-2016/069910 A1 | 5/2016 |
| WO | WO-2016/069912 A1 | 5/2016 |
| WO | WO-2016/070037 A2 | 5/2016 |
| WO | WO-2016/070070 A1 | 5/2016 |
| WO | WO-2016/070129 A1 | 5/2016 |
| WO | WO-2016/072399 A1 | 5/2016 |
| WO | WO-2016/072936 A1 | 5/2016 |
| WO | WO-2016/073433 A1 | 5/2016 |
| WO | WO-2016/073559 A1 | 5/2016 |
| WO | WO-2016/073990 A2 | 5/2016 |
| WO | WO-2016/075662 A2 | 5/2016 |
| WO | WO-2016/077273 A1 | 5/2016 |
| WO | WO-2016/077350 A1 | 5/2016 |
| WO | WO-2016/080097 A1 | 5/2016 |
| WO | WO-2016/080795 A1 | 5/2016 |
| WO | WO-2016/081923 A2 | 5/2016 |
| WO | WO-2016/081924 A1 | 5/2016 |
| WO | WO-2016/082135 A1 | 6/2016 |
| WO | WO-2016/083811 A1 | 6/2016 |
| WO | WO-2016/084084 A1 | 6/2016 |
| WO | WO-2016/084088 A1 | 6/2016 |
| WO | WO-2016/086177 A2 | 6/2016 |
| WO | WO-2016/089433 A1 | 6/2016 |
| WO | WO-2016/089866 A1 | 6/2016 |
| WO | WO-2016/089883 A1 | 6/2016 |
| WO | WO-2016/090385 A1 | 6/2016 |
| WO | WO-2016/094845 A2 | 6/2016 |
| WO | WO-2016/094867 A1 | 6/2016 |
| WO | WO-2016/094872 A1 | 6/2016 |
| WO | WO-2016/094874 A1 | 6/2016 |
| WO | WO-2016/094880 A1 | 6/2016 |
| WO | WO-2016/094888 A1 | 6/2016 |
| WO | WO-2016/097212 A1 | 6/2016 |
| WO | WO-2016/097231 A2 | 6/2016 |
| WO | WO-2016/097751 A1 | 6/2016 |
| WO | WO-2016/099887 A1 | 6/2016 |
| WO | WO-2016/100272 A1 | 6/2016 |
| WO | WO-2016/100389 A1 | 6/2016 |
| WO | WO-2016/100568 A1 | 6/2016 |
| WO | WO-2016/100571 A1 | 6/2016 |
| WO | WO-2016/100951 A2 | 6/2016 |
| WO | WO-2016/100955 A2 | 6/2016 |
| WO | WO-2016/100974 A1 | 6/2016 |
| WO | WO-2016/103233 A2 | 6/2016 |
| WO | WO-2016/104716 A1 | 6/2016 |
| WO | WO-2016/106236 A1 | 6/2016 |
| WO | WO-2016/106239 A1 | 6/2016 |
| WO | WO-2016/106244 A1 | 6/2016 |
| WO | WO-2016/106338 A2 | 6/2016 |
| WO | WO-2016/108926 A1 | 7/2016 |
| WO | WO-2016/109255 A1 | 7/2016 |
| WO | WO-2016/109840 A2 | 7/2016 |
| WO | WO-2016/110214 A1 | 7/2016 |
| WO | WO-2016/110453 A1 | 7/2016 |
| WO | WO-2016/110511 A1 | 7/2016 |

(56) References Cited

FOREIGN PATENT DOCUMENTS

| | | |
|---|---|---|
| WO | WO-2016/110512 A1 | 7/2016 |
| WO | WO-2016/112242 A1 | 7/2016 |
| WO | WO-2016/112351 A1 | 7/2016 |
| WO | WO-2016/112963 A1 | 7/2016 |
| WO | WO-2016/114972 A1 | 7/2016 |
| WO | WO-2016/115179 A1 | 7/2016 |
| WO | WO-2016/115326 A1 | 7/2016 |
| WO | WO-2016/115355 A1 | 7/2016 |
| WO | WO-2016/116032 A1 | 7/2016 |
| WO | WO-2016/120480 A1 | 8/2016 |
| WO | WO-2016/123071 A1 | 8/2016 |
| WO | WO-2016/123230 A1 | 8/2016 |
| WO | WO-2016/123243 A1 | 8/2016 |
| WO | WO-2016/123578 A1 | 8/2016 |
| WO | WO-2016/130600 A2 | 8/2016 |
| WO | WO-2016/130697 A1 | 8/2016 |
| WO | WO-2016/132122 A1 | 8/2016 |
| WO | WO-2016/133165 A1 | 8/2016 |
| WO | WO-2016/135507 A1 | 9/2016 |
| WO | WO-2016/135557 A2 | 9/2016 |
| WO | WO-2016/135558 A2 | 9/2016 |
| WO | WO-2016/135559 A2 | 9/2016 |
| WO | WO-2016/137774 A1 | 9/2016 |
| WO | WO-2016/137949 A1 | 9/2016 |
| WO | WO-2016/141224 A1 | 9/2016 |
| WO | WO-2016/141893 A1 | 9/2016 |
| WO | WO-2016/142719 A1 | 9/2016 |
| WO | WO-2016/145150 A2 | 9/2016 |
| WO | WO-2016/148994 A1 | 9/2016 |
| WO | WO-2016/149484 A2 | 9/2016 |
| WO | WO-2016/149547 A1 | 9/2016 |
| WO | WO-2016/150336 A1 | 9/2016 |
| WO | WO-2016/150855 A1 | 9/2016 |
| WO | WO-2016/154016 A2 | 9/2016 |
| WO | WO-2016/154579 A2 | 9/2016 |
| WO | WO-2016/154596 A1 | 9/2016 |
| WO | WO-2016/155482 A1 | 10/2016 |
| WO | WO-2016/161004 A1 | 10/2016 |
| WO | WO-2016/161207 A1 | 10/2016 |
| WO | WO-2016/161260 A1 | 10/2016 |
| WO | WO-2016/161380 A1 | 10/2016 |
| WO | WO-2016/161446 A1 | 10/2016 |
| WO | WO-2016/164356 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/170484 A1 | 10/2016 |
| WO | WO-2016/172359 A2 | 10/2016 |
| WO | WO-2016/172727 A1 | 10/2016 |
| WO | WO-2016/174056 A1 | 11/2016 |
| WO | WO-2016/174151 A1 | 11/2016 |
| WO | WO-2016/174250 A1 | 11/2016 |
| WO | WO-2016/176191 A1 | 11/2016 |
| WO | WO-2016/176404 A1 | 11/2016 |
| WO | WO-2016/176690 A2 | 11/2016 |
| WO | WO-2016/177682 A1 | 11/2016 |
| WO | WO-2016/178207 A1 | 11/2016 |
| WO | WO-2016/179038 A1 | 11/2016 |
| WO | WO-2016/179112 A1 | 11/2016 |
| WO | WO-2016/181357 A1 | 11/2016 |
| WO | WO-2016/182893 A1 | 11/2016 |
| WO | WO-2016/182917 A1 | 11/2016 |
| WO | WO-2016/182959 A1 | 11/2016 |
| WO | WO-2016/183236 A1 | 11/2016 |
| WO | WO-2016/183298 A2 | 11/2016 |
| WO | WO-2016/183345 A1 | 11/2016 |
| WO | WO-2016/183402 A2 | 11/2016 |
| WO | WO-2016/183438 A1 | 11/2016 |
| WO | WO-2016/183448 A1 | 11/2016 |
| WO | WO-2016/184955 A2 | 11/2016 |
| WO | WO-2016/184989 A1 | 11/2016 |
| WO | WO-2016/185411 A1 | 11/2016 |
| WO | WO-2016/186745 A1 | 11/2016 |
| WO | WO-2016/186772 A2 | 11/2016 |
| WO | WO-2016/186946 A1 | 11/2016 |
| WO | WO-2016/186953 A1 | 11/2016 |
| WO | WO-2016/187717 A1 | 12/2016 |
| WO | WO-2016/187904 A1 | 12/2016 |
| WO | WO-2016/191684 A1 | 12/2016 |
| WO | WO-2016/191869 A1 | 12/2016 |
| WO | WO-2016/196273 A1 | 12/2016 |
| WO | WO-2016/196282 A1 | 12/2016 |
| WO | WO-2016/196308 A1 | 12/2016 |
| WO | WO-2016/196361 A1 | 12/2016 |
| WO | WO-2016/196499 A1 | 12/2016 |
| WO | WO-2016/196539 A2 | 12/2016 |
| WO | WO-2016/196655 A1 | 12/2016 |
| WO | WO-2016/196805 A1 | 12/2016 |
| WO | WO-2016/196887 A1 | 12/2016 |
| WO | WO-2016/197132 A1 | 12/2016 |
| WO | WO-2016/197133 A1 | 12/2016 |
| WO | WO-2016/197354 A1 | 12/2016 |
| WO | WO-2016/197355 A1 | 12/2016 |
| WO | WO-2016/197356 A1 | 12/2016 |
| WO | WO-2016/197357 A1 | 12/2016 |
| WO | WO-2016/197358 A1 | 12/2016 |
| WO | WO-2016/197359 A1 | 12/2016 |
| WO | WO-2016/197360 A1 | 12/2016 |
| WO | WO-2016/197361 A1 | 12/2016 |
| WO | WO-2016/197362 A1 | 12/2016 |
| WO | WO-2016/198361 A1 | 12/2016 |
| WO | WO-2016/198500 A1 | 12/2016 |
| WO | WO-2016/200263 A1 | 12/2016 |
| WO | WO-2016/201047 A1 | 12/2016 |
| WO | WO-2016/201138 A1 | 12/2016 |
| WO | WO-2016/201152 A1 | 12/2016 |
| WO | WO-2016/201153 A1 | 12/2016 |
| WO | WO-2016/201155 A1 | 12/2016 |
| WO | WO-2016/205276 A1 | 12/2016 |
| WO | WO-2016/205613 A1 | 12/2016 |
| WO | WO-2016/205623 A1 | 12/2016 |
| WO | WO-2016/205680 A1 | 12/2016 |
| WO | WO-2016/205688 A2 | 12/2016 |
| WO | WO-2016/205703 A1 | 12/2016 |
| WO | WO-2016/205711 A1 | 12/2016 |
| WO | WO-2016/205728 A1 | 12/2016 |
| WO | WO-2016/205745 A2 | 12/2016 |
| WO | WO-2016/205749 A1 | 12/2016 |
| WO | WO-2016/205759 A2 | 12/2016 |
| WO | WO-2016/205764 A2 | 12/2016 |
| WO | WO-2017/001572 A1 | 1/2017 |
| WO | WO-2017/001988 A1 | 1/2017 |
| WO | WO-2017/004261 A1 | 1/2017 |
| WO | WO-2017/004279 A2 | 1/2017 |
| WO | WO-2017/004616 A1 | 1/2017 |
| WO | WO-2017/005807 A1 | 1/2017 |
| WO | WO-2017/009399 A1 | 1/2017 |
| WO | WO-2017/011519 A1 | 1/2017 |
| WO | WO-2017/011721 A1 | 1/2017 |
| WO | WO-2017/011804 A1 | 1/2017 |
| WO | WO-2017/015015 A1 | 1/2017 |
| WO | WO-2017/015101 A1 | 1/2017 |
| WO | WO-2017/015567 A1 | 1/2017 |
| WO | WO-2017/015637 A1 | 1/2017 |
| WO | WO-2017/017016 A1 | 2/2017 |
| WO | WO-2017/019867 A1 | 2/2017 |
| WO | WO-2017/019895 A1 | 2/2017 |
| WO | WO-2017/023803 A1 | 2/2017 |
| WO | WO-2017/023974 A1 | 2/2017 |
| WO | WO-2017/024047 A1 | 2/2017 |
| WO | WO-2017/024319 A1 | 2/2017 |
| WO | WO-2017/024343 A1 | 2/2017 |
| WO | WO-2017/024602 A1 | 2/2017 |
| WO | WO-2017/025323 A1 | 2/2017 |
| WO | WO-2017/027423 A1 | 2/2017 |
| WO | WO-2017/028768 A1 | 2/2017 |
| WO | WO-2017/029664 A1 | 2/2017 |
| WO | WO-2017/031360 A1 | 2/2017 |
| WO | WO-2017/031483 A1 | 2/2017 |
| WO | WO-2017/035416 A2 | 3/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/040786 A1 | 3/2017 |

(56) References Cited

FOREIGN PATENT DOCUMENTS

| | | |
|---|---|---|
| WO | WO-2017/040793 A1 | 3/2017 |
| WO | WO-2017/040813 A2 | 3/2017 |
| WO | WO-2017/043573 A1 | 3/2017 |
| WO | WO-2017/043656 A1 | 3/2017 |
| WO | WO-2017/044419 A1 | 3/2017 |
| WO | WO-2017/044776 A1 | 3/2017 |
| WO | WO-2017/044857 A2 | 3/2017 |
| WO | WO-2017/049129 A2 | 3/2017 |
| WO | WO-2017/050963 A1 | 3/2017 |
| WO | WO-2017/053312 A1 | 3/2017 |
| WO | WO-2017/053431 A2 | 3/2017 |
| WO | WO-2017/053713 A1 | 3/2017 |
| WO | WO-2017/053729 A1 | 3/2017 |
| WO | WO-2017/053753 A1 | 3/2017 |
| WO | WO-2017/053762 A1 | 3/2017 |
| WO | WO-2017/053879 A1 | 3/2017 |
| WO | WO-2017/058658 A2 | 4/2017 |
| WO | WO-2017/062605 A1 | 4/2017 |
| WO | WO-2017/062723 A1 | 4/2017 |
| WO | WO-2017/062754 A1 | 4/2017 |
| WO | WO-2017/062855 A1 | 4/2017 |
| WO | WO-2017/062886 A1 | 4/2017 |
| WO | WO-2017/062983 A1 | 4/2017 |
| WO | WO-2017/064439 A1 | 4/2017 |
| WO | WO-2017/064546 A1 | 4/2017 |
| WO | WO-2017/064566 A2 | 4/2017 |
| WO | WO-2017/066175 A1 | 4/2017 |
| WO | WO-2017/066497 A2 | 4/2017 |
| WO | WO-2017/066588 A2 | 4/2017 |
| WO | WO-2017/068377 A1 | 4/2017 |
| WO | WO-2017/069829 A1 | 4/2017 |
| WO | WO-2017/070029 A1 | 4/2017 |
| WO | WO-2017/070032 A1 | 4/2017 |
| WO | WO-2017/070169 A1 | 4/2017 |
| WO | WO-2017/070284 A1 | 4/2017 |
| WO | WO-2017/070598 A1 | 4/2017 |
| WO | WO-2017/070605 A1 | 4/2017 |
| WO | WO-2017/070632 A2 | 4/2017 |
| WO | WO-2017/070633 A2 | 4/2017 |
| WO | WO-2017/072590 A1 | 5/2017 |
| WO | WO-2017/074526 A1 | 5/2017 |
| WO | WO-2017/074962 A1 | 5/2017 |
| WO | WO-2017/075261 A1 | 5/2017 |
| WO | WO-2017/075475 A1 | 5/2017 |
| WO | WO-2017/077135 A1 | 5/2017 |
| WO | WO-2017/077329 A2 | 5/2017 |
| WO | WO-2017/078751 A1 | 5/2017 |
| WO | WO-2017/079400 A1 | 5/2017 |
| WO | WO-2017/079428 A1 | 5/2017 |
| WO | WO-2017/079673 A1 | 5/2017 |
| WO | WO-2017/079724 A1 | 5/2017 |
| WO | WO-2017/081097 A1 | 5/2017 |
| WO | WO-2017/081288 A1 | 5/2017 |
| WO | WO-2017/083368 A1 | 5/2017 |
| WO | WO-2017/083722 A1 | 5/2017 |
| WO | WO-2017/083766 A1 | 5/2017 |
| WO | WO-2017/087395 A1 | 5/2017 |
| WO | WO-2017/090724 A1 | 6/2017 |
| WO | WO-2017/091510 A1 | 6/2017 |
| WO | WO-2017/091630 A1 | 6/2017 |
| WO | WO-2017/092201 A1 | 6/2017 |
| WO | WO-2017/093370 A1 | 6/2017 |
| WO | WO-2017/095111 A1 | 6/2017 |
| WO | WO-2017/096041 A1 | 6/2017 |
| WO | WO-2017/096237 A1 | 6/2017 |
| WO | WO-2017/100158 A1 | 6/2017 |
| WO | WO-2017/100431 A2 | 6/2017 |
| WO | WO-2017/104404 A1 | 6/2017 |
| WO | WO-2017/105251 A1 | 6/2017 |
| WO | WO-2017/105350 A1 | 6/2017 |
| WO | WO-2017/105991 A1 | 6/2017 |
| WO | WO-2017/106414 A1 | 6/2017 |
| WO | WO-2017/106528 A2 | 6/2017 |
| WO | WO-2017/106537 A2 | 6/2017 |
| WO | WO-2017/106569 A1 | 6/2017 |
| WO | WO-2017/106616 A1 | 6/2017 |
| WO | WO-2017/106657 A1 | 6/2017 |
| WO | WO-2017/106767 A1 | 6/2017 |
| WO | WO-2017/112620 A1 | 6/2017 |
| WO | WO-2017/115268 A1 | 7/2017 |
| WO | WO-2017/117395 A1 | 7/2017 |
| WO | WO-2017/118720 A1 | 7/2017 |
| WO | WO-2017/123609 A1 | 7/2017 |
| WO | WO-2017/123910 A1 | 7/2017 |
| WO | WO-2017/124086 A1 | 7/2017 |
| WO | WO-2017/124100 A1 | 7/2017 |
| WO | WO-2017/124652 A1 | 7/2017 |
| WO | WO-2017/126987 A1 | 7/2017 |
| WO | WO-2017/127807 A1 | 7/2017 |
| WO | WO-2017/131237 A1 | 8/2017 |
| WO | WO-2017/132112 A1 | 8/2017 |
| WO | WO-2017/136520 A1 | 8/2017 |
| WO | WO-2017/136629 A1 | 8/2017 |
| WO | WO-2017/136794 A1 | 8/2017 |
| WO | WO-2017/139264 A1 | 8/2017 |
| WO | WO-2017/139505 A2 | 8/2017 |
| WO | WO-2017/142835 A1 | 8/2017 |
| WO | WO-2017/142999 A2 | 8/2017 |
| WO | WO-2017/143042 A2 | 8/2017 |
| WO | WO-2017/147278 A1 | 8/2017 |
| WO | WO-2017/147432 A1 | 8/2017 |
| WO | WO-2017/147446 A1 | 8/2017 |
| WO | WO-2017/147555 A1 | 8/2017 |
| WO | WO-2017/151444 A1 | 9/2017 |
| WO | WO-2017/152015 A1 | 9/2017 |
| WO | WO-2017/157422 A1 | 9/2017 |
| WO | WO-2017/158153 A1 | 9/2017 |
| WO | WO-2017/160689 A1 | 9/2017 |
| WO | WO-2017/160752 A1 | 9/2017 |
| WO | WO-2017/160890 A1 | 9/2017 |
| WO | WO-2017/161068 A1 | 9/2017 |
| WO | WO-2017/165826 A1 | 9/2017 |
| WO | WO-2017/165862 A1 | 9/2017 |
| WO | WO-2017/172644 A2 | 10/2017 |
| WO | WO-2017/172645 A2 | 10/2017 |
| WO | WO-2017/172860 A1 | 10/2017 |
| WO | WO-2017/173004 A1 | 10/2017 |
| WO | WO-2017/173054 A1 | 10/2017 |
| WO | WO-2017/173092 A1 | 10/2017 |
| WO | WO-2017/174329 A1 | 10/2017 |
| WO | WO-2017/176529 A1 | 10/2017 |
| WO | WO-2017/178590 A1 | 10/2017 |
| WO | WO-2017/180694 A1 | 10/2017 |
| WO | WO-2017/180711 A1 | 10/2017 |
| WO | WO-2017/180915 A2 | 10/2017 |
| WO | WO-2017/180926 A1 | 10/2017 |
| WO | WO-2017/181107 A2 | 10/2017 |
| WO | WO-2017/181735 A2 | 10/2017 |
| WO | WO-2017/182468 A1 | 10/2017 |
| WO | WO-2017/184334 A1 | 10/2017 |
| WO | WO-2017/184768 A1 | 10/2017 |
| WO | WO-2017/184786 A1 | 10/2017 |
| WO | WO-2017/186550 A1 | 11/2017 |
| WO | WO-2017/189308 A1 | 11/2017 |
| WO | WO-2017/189336 A1 | 11/2017 |
| WO | WO-2017/190257 A1 | 11/2017 |
| WO | WO-2017/190664 A1 | 11/2017 |
| WO | WO-2017/191210 A1 | 11/2017 |
| WO | WO-2017/192172 A1 | 11/2017 |
| WO | WO-2017/192512 A2 | 11/2017 |
| WO | WO-2017/192544 A1 | 11/2017 |
| WO | WO-2017/192573 A1 | 11/2017 |
| WO | WO-2017/193029 A2 | 11/2017 |
| WO | WO-2017/193053 A1 | 11/2017 |
| WO | WO-2017/196768 A1 | 11/2017 |
| WO | WO-2017/197038 A1 | 11/2017 |
| WO | WO-2017/197238 A1 | 11/2017 |
| WO | WO-2017/197301 A1 | 11/2017 |
| WO | WO-2017/205290 A1 | 11/2017 |
| WO | WO-2017/205423 A1 | 11/2017 |
| WO | WO-2017/207589 A1 | 12/2017 |
| WO | WO-2017/208247 A1 | 12/2017 |
| WO | WO-2017/209809 A1 | 12/2017 |
| WO | WO-2017/213896 A1 | 12/2017 |

(56) References Cited

FOREIGN PATENT DOCUMENTS

| | | |
|---|---|---|
| WO | WO-2017/213898 A2 | 12/2017 |
| WO | WO-2017/214460 A1 | 12/2017 |
| WO | WO-2017/216392 A1 | 12/2017 |
| WO | WO-2017/216771 A2 | 12/2017 |
| WO | WO-2017/219027 A1 | 12/2017 |
| WO | WO-2017/219033 A1 | 12/2017 |
| WO | WO-2017/220751 A1 | 12/2017 |
| WO | WO-2017/222370 A1 | 12/2017 |
| WO | WO-2017/222773 A1 | 12/2017 |
| WO | WO-2017/222834 A1 | 12/2017 |
| WO | WO-2017/223107 A1 | 12/2017 |
| WO | WO-2017/223330 A1 | 12/2017 |
| WO | WO-2018/000657 A1 | 1/2018 |
| WO | WO-2018/002719 A1 | 1/2018 |
| WO | WO-2018/005117 A1 | 1/2018 |
| WO | WO-2018/005289 A2 | 1/2018 |
| WO | WO-2018/005691 A1 | 1/2018 |
| WO | WO-2018/005782 A1 | 1/2018 |
| WO | WO-2018/005873 A1 | 1/2018 |
| WO | WO-2018/009520 A1 | 1/2018 |
| WO | WO-2018/009562 A1 | 1/2018 |
| WO | WO-2018/009822 A1 | 1/2018 |
| WO | WO-2018/013821 A1 | 1/2018 |
| WO | WO-2018/013990 A1 | 1/2018 |
| WO | WO-2018/027078 A1 | 2/2018 |
| WO | WO-2018/045630 A1 | 3/2018 |
| WO | WO-2018/048827 A1 | 3/2018 |
| WO | WO-2018/049168 A1 | 3/2018 |
| WO | WO-2018/051347 A1 | 3/2018 |
| WO | WO-2018/058064 A1 | 3/2018 |
| WO | WO-2018/062866 A2 | 4/2018 |
| WO | WO-2018/064352 A1 | 4/2018 |
| WO | WO-2018/064371 A1 | 4/2018 |
| WO | WO-2018/064516 A1 | 4/2018 |
| WO | WO-2018/067546 A1 | 4/2018 |
| WO | WO-2018/067846 A1 | 4/2018 |
| WO | WO-2018/068053 A2 | 4/2018 |
| WO | WO-2018/069474 A1 | 4/2018 |
| WO | WO-2018/071623 A2 | 4/2018 |
| WO | WO-2018/071663 A1 | 4/2018 |
| WO | WO-2018/071868 A1 | 4/2018 |
| WO | WO-2018/071892 A1 | 4/2018 |
| WO | WO-2018/074979 | 4/2018 |

OTHER PUBLICATIONS

Lyons DM et al. Efficient Recogntion of an Unpaired Lesion by a DNA Repair Glycosylase. JACS. 2009. 131. p. 17742-17743 (Year: 2009).*
Lau AY et al. Molecular Basis for Discriminating Between Normal and Damaged Bases by the Human Alkyladenine Glycosylase, AAG. 2000. PNAS. vol. 97. No. 25. p. 13573-13578 (Year: 2000).*
International Search Report and Written Opinion for PCT/US2017/056671, dated Feb. 20, 2018.
U.S. Appl. No. 61/874,746, filed Sep. 6, 2013, Liu et al.
U.S. Appl. No. 61/874,682, filed Sep. 6, 2013, Liu et al.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Bolotin et al., Clustered regularly interspaced short palindrome repeats (CRISPRs) have spacers of extrachromosomal origin. Microbiology. Aug. 2005;151(Pt 8):2551-61.
Brouns et al., Small CRISPR RNAs guide antiviral defense in prokaryotes. Science. Aug. 15, 2008;321(5891):960-4. doi: 10.1126/science.1159689.
Buchwald et al., Long-term, continuous intravenous heparin administration by an implantable infusion pump in ambulatory patients with recurrent venous thrombosis. Surgery. Oct. 1980;88(4):507-16.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/1389450117015121710917.
During et al., Controlled release of dopamine from a polymeric brain implant: in vivo characterization. Ann Neurol. Apr. 1989;25(4):351-6.
Ferretti et al., Complete genome sequence of an M1 strain of *Streptococcus pyogenes*. Proc Natl Acad Sci U S A. Apr. 10, 2001;98(8):4658-63.
Fukui et al., DNA Mismatch Repair in Eukaryotes and Bacteria. J Nucleic Acids. Jul. 27, 2010;2010. pii: 260512. doi: 10.4061/2010/260512.
Garneau et al., The CRISPR/Cas bacterial immune system cleaves bacteriophage and plasmid DNA. Nature. Nov. 4, 2010;468(7320):67-71. doi: 10.1038/nature09523.
Heller et al., Replisome assembly and the direct restart of stalled replication forks. Nat Rev Mol Cell Biol. Dec. 2006;7(12):932-43. Epub Nov. 8, 2006.
Howard et al., Intracerebral drug delivery in rats with lesion-induced memory deficits. J Neurosurg. Jul. 1989;71(1):105-12.
International Search Report and Written Opinion for PCT/US2017/068114, dated Mar. 20, 2018.
Ishino et al., Nucleotide sequence of the iap gene, responsible for alkaline phosphatase isozyme conversion in *Escherichia coli*, and identification of the gene product. J Bacteriol. Dec. 1987;169(12):5429-33.
Jansen et al., Identification of genes that are associated with DNA repeats in prokaryotes. Mol Microbiol. Mar. 2002;43(6):1565-75.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Kunz et al., DNA Repair in mammalian cells: Mismatched repair: variations on a theme. Cell Mol Life Sci. Mar. 2009;66(6):1021-38. doi: 10.1007/s00018-009-8739-9.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Lee et al., Failure to detect DNA-guided genome editing using Natronobacterium gregoryi Argonaute. Nat Biotechnol. Nov. 28, 2016;35(1):17-18. doi: 10.1038/nbt.3753.
Levy et al., Inhibition of calcification of bioprosthetic heart valves by local controlled-release diphosphonate. Science. Apr. 12, 1985;228(4696):190-2.
Lieber et al., Mechanism and regulation of human non-homologous DNA end-joining. Nat Rev Mol Cell Biol. Sep. 2003;4(9):712-20.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Evolution and classification of the CRISPR-Cas systems. Nat Rev Microbiol. Jun. 2011;9(6):467-77. doi: 10.1038/nrmicro2577. Epub May 9, 2011.
Marraffini et al., CRISPR interference limits horizontal gene transfer in Staphylococci by targeting DNA. Science. Dec. 19, 2008;322(5909):1843-5. doi: 10.1126/science.1165771.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Mojica et al., Intervening sequences of regularly spaced prokaryotic repeats derive from foreign genetic elements. J Mol Evol. Feb. 2005;60(2):174-82.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Ray et al., Homologous recombination: ends as the means. Trends Plant Sci. Oct. 2002;7(10):435-40.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.

(56) References Cited

OTHER PUBLICATIONS

Saudek et al., A preliminary trial of the programmable implantable medication system for insulin delivery. N Engl J Med. Aug. 31, 1989;321(9):574-9.
Sefton et al., Implantable pumps. Crit Rev Biomed Eng. 1987;14(3):201-40.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Stephens et al., The landscape of cancer genes and mutational processes in breast cancer. Nature Jun. 2012;486:400-404. doi:10.1038/nature11017.
Vagner et al., Efficiency of homologous DNA recombination varies along the Bacillus subtilis chromosome. J Bacteriol. Sep. 1988;170(9):3978-82.
Zhang et al., Stabilized plasmid-lipid particles for regional gene therapy: formulation and transfection properties. Gene Ther. Aug. 1999;6(8):1438-47.
Extended European Search Report for EP 15830407.1, dated Mar. 2, 2018.
International Preliminary Report on Patentability for PCT/US2016/058344, dated May 3, 2018.
International Search Report and Written Opinion for PCT/US2017/068105, dated Apr. 4, 2018.
Liu et al., Distance determination by GIY-YIG intron endonucleases: discrimination between repression and cleavage functions. Nucleic Acids Res. Mar. 31, 2006;34(6):1755-64. Print 2006.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Wang et al., CRISPR-Cas9 Targeting of PCSK9 in Human Hepatocytes In Vivo—Brief Report. Arterioscler Thromb Vasc Biol. May 2016;36(5):783-6. doi: 10.1161/ATVBAHA.116.307227. Epub Mar. 3, 2016.
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], Thermo Fisher Scientific—How Cationic Lipid Mediated Transfection Works, retrieved from the internet Aug. 27, 2015. 2 pages.
Abudayyeh et al., C2c2 is a single-component programmable RNA-guided RNA-targeting CRISPR effector. Science Aug. 2016;353(6299):aaf5573. DOI: 10.1126/science.aaf5573.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Alexandrov et al., Signatures of mutational processes in human cancer. Nature. Aug. 22, 2013;500(7463):415-21. doi: 10.1038/nature12477. Epub Aug. 14, 2013.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Arnold et al., Mutants of Tn3 resolvase which do not require accessory binding sites for recombination activity. EMBO J. Mar. 1, 1999;18(5):1407-14.

Barnes et al., Repair and genetic consequences of endogenous DNA base damage in mammalian cells. Annu Rev Genet. 2004;38:445-76.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Beale et al., Comparison of the differential context-dependence of DNA deamination by APOBEC enzymes: correlation with mutation spectra in vivo. J Mol Biol. Mar. 26, 2004;337(3):585-96.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Beumer et al., Efficient gene targeting in *Drosophila* with zinc-finger nucleases. Genetics. Apr. 2006;172(4):2391-403. Epub Feb. 1, 2006.
Birling et al., Site-specific recombinases for manipulation of the mouse genome. Methods Mol Biol. 2009;561:245-63. doi: 10.1007/978-1-60327-019-9_16.
Bitinaite et al., FokI dimerization is required for DNA cleavage. Proc Natl Acad Sci U S A. Sep. 1, 1998;95(18):10570-5.
Boch, TALEs of genome targeting. Nat Biotechnol. Feb. 2011;29(2):135-6. Doi: 10.1038/nbt.1767.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Borman, Improved route to single-base genome editing. Chemical & Engineering News, Apr. 25, 2016;94(17)p5. http://cen.acs.org/articles/94/i17/Improved-route-single-base-genome.html.
Branden and Tooze, Introduction to Protein Structure. 1999; 2nd edition. Garland Science Publisher: 3-12.
Britt et al., Re-engineering plant gene targeting. Trends Plant Sci. Feb. 2003;8(2):90-5.
Brown et al., Serine recombinases as tools for genome engineering. Methods. Apr. 2011;53(4):372-9. doi: 10.1016/j.ymeth.2010.12.031. Epub Dec. 30, 2010.
Brusse et al., Spinocerebellar ataxia associated with a mutation in the fibroblast growth factor 14 gene (SCA27): A new phenotype. Mov Disord. Mar. 2006;21(3):396-401.
Buchholz et al., Alteration of Cre recombinase site specificity by substrate-linked protein evolution. Nat Biotechnol. Nov. 2001;19(11):1047-52.
Bulow et al., Multienzyme systems obtained by gene fusion. Trends Biotechnol. Jul. 1991;9(7):226-31.
Burstein et al., New CRISPR-Cas systems from uncultivated microbes. Nature Feb. 2017;542(7640):237-240.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Caldecott et al., Single-strand break repair and genetic disease. Nat Rev Genet. Aug. 2008;9(8):619-31. doi: 10.1038/nrg2380.
Cameron, Recent advances in transgenic technology. Mol Biotechnol. Jun. 1997;7(3):253-65.
Cargill et al., Characterization of single-nucleotide polymorphisms in coding regions of human genes. Nat Genet. Jul. 1999;22(3):231-8.
Caron et al., Intracellular delivery of a Tat-eGFP fusion protein into muscle cells. Mol Ther. Mar. 2001;3(3):310-8.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

(56) References Cited

OTHER PUBLICATIONS

Carroll, A CRISPR approach to gene targeting. Mol Ther. Sep. 2012;20(9):1658-60. doi: 10.1038/mt.2012.171.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Charpentier et al., Biotechnology: Rewriting a genome. Nature. Mar. 7, 2013;495(7439):50-1. doi: 10.1038/495050a.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. Jun. 14, 2016. doi:https://doi.org/10.1101/058974. [Preprint].

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chesnoy et al., Structure and function of lipid-DNA complexes for gene delivery. Annu Rev Biophys Biomol Struct. 2000;29:27-47.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chichili et al., Linkers in the structural biology of protein-protein interactions. Protein Science. 2013;22:153-67.

Chipev et al., A leucine-proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christian et al., Targeting DNA double-strand breaks with TAL effector nucleases. Genetics. Oct. 2010;186(2):757-61. Doi: 10.1534/genetics.110.120717. Epub Jul. 26, 2010.

Chu et al., Increasing the efficiency of homology-directed repair for CRISPR-Cas9-induced precise gene editing in mammalian cells. Nat Biotech. Feb. 13, 2015;33:543-8.

Chung-Il et al., Artificial control of gene expression in mammalian cells by modulating RNA interference through aptamer-small molecule interaction. RNA. May 2006;12(5):710-6. Epub Apr. 10, 2006.

Chylinski et al., The tracrRNA and Cas9 families of type II CRISPR-Cas immunity systems. RNA Biol. May 2013;10(5):726-37. doi: 10.4161/rna.24321. Epub Apr. 5, 2013.

Cole-Strauss et al., Correction of the mutation responsible for sickle cell anemia by an RNA-DNA oligonucleotide. Science. Sep. 6, 1996;273(5280):1386-9.

Cong et al., Multiplex genome engineering using CRISPR/Cas systems. Science. Feb. 15, 2013;339(6121):819-23. doi: 10.1126/science.1231143. Epub Jan. 3, 2013.

Conticello, The AID/APOBEC family of nucleic acid mutators. Genome Biol. 2008;9(6):229. doi: 10.1186/gb-2008-9-6-229. Epub Jun. 17, 2008.

Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.

Cox et al., Therapeutic genome editing: prospects and challenges. Nat Med. Feb. 2015;21(2):121-31. doi: 10.1038/nm.3793.

Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.

Cradick et al., ZFN-site searches genomes for zinc finger nuclease target sites and off-target sites. BMC Bioinformatics. May 13, 2011;12:152. doi: 10.1186/1471-2105-12-152.

Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.

Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.

Cunningham et al., Ensembl 2015. Nucleic Acids Res. Jan. 2015;43(Database issue):D662-9. doi: 10.1093/nar/gku1010. Epub Oct. 28, 2014.

Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.

Davis et al., Small molecule-triggered Cas9 protein with improved genome-editing specificity. Nat Chem Biol. May 2015;11(5):316-8. doi: 10.1038/nchembio.1793. Epub Apr. 6, 2015.

De Souza, Primer: genome editing with engineered nucleases. Nat Methods. Jan. 2012;9(1):27.

Deltcheva et al., CRISPR RNA maturation by trans-encoded small RNA and host factor RNase III. Nature. Mar. 31, 2011;471(7340):602-7. doi: 10.1038/nature09886.

Dicarlo et al., Genome engineering in *Saccharomyces cerevisiae* using CRISPR-Cas systems. Nucleic Acids Research Apr. 2013;41(7):4336-43.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.

Doudna et al., Genome editing. The new frontier of genome engineering with CRISPR-Cas9. Science. Nov. 28, 2014;346(6213):1258096. doi: 10.1126/science.1258096.

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.

Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.

East-Seletsky et al., Two distinct RNase activities of CRISPR-C2c2 enable guide-RNA processing and RNA detection. Nature Oct. 2016;538(7624):270-3.

Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Fine et al., Trans-spliced Cas9 allows cleavage of HBB and CCR5 genes in human cells using compact expression cassettes. Scientific Reports 2015;5(1):Article number: 10777. doi:10.1038/srep10777. With Supplementary Information.

Fonfara et al., Phylogeny of Cas9 determines functional exchangeability of dual-RNA and Cas9 among orthologous type II CRISPR-

(56) References Cited

OTHER PUBLICATIONS

Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Gasiunas et al., Cas9-crRNA ribonucleoprotein complex mediates specific Dna cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Genbank Submission; NIH/NCBI, Accession No. J04623. Kita et al., Apr. 26, 1993. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NP_472073.1. Glaser et al., Jun. 27, 2013. 2 pages.
Genbank Submission; NIH/NCBI, Accession No. P42212. Prasher et al., Mar. 19, 2014. 7 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.
Hale et al., RNA-guided RNA cleavage by a CRISPR RNA-Cas protein complex. Cell. Nov. 25, 2009;139(5):945-56. doi: 10.1016/j.cell.2009.07.040.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.
Harris et al., RNA editing enzyme APOBEC1 and some of its homologs can act as DNA mutators. Mol Cell. Nov. 2002;10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hill et al., Functional analysis of conserved histidines in ADP-glucose pyrophosphorylase from *Escherichia coli*.Biochem Biophys Res Commun. Mar. 17, 1998;244(2):573-7.
Hilton et al., Enabling functional genomics with genome engineering. Genome Res. Oct. 2015;25(10):1442-55. doi: 10.1101/gr.190124.115.

(56) References Cited

OTHER PUBLICATIONS

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.

Horvath et al., CRISPR/Cas, the immune system of bacteria and archaea. Science. Jan. 8, 2010;327(5962):167-70. doi: 10.1126/science.1179555.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houdebine, The methods to generate transgenic animals and to control transgene expression. J Biotechnol. Sep. 25, 2002;98(2-3):145-60.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Huang et al., Heritable gene targeting in zebrafish using customized TALENs. Nat Biotechnol. Aug. 5, 2011;29(8):699-700. doi: 10.1038/nbt.1939.

Humbert et al., Targeted gene therapies: tools, applications, optimization. Crit Rev Biochem Mol Biol. May-Jun. 2012;47(3):264-81. doi: 10.3109/10409238.2012.658112.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Ikediobi et al., Mutation analysis of 24 known cancer genes in the NCI-60 cell line set. Mol Cancer Ther. Nov. 2006;5(11):2606-12. Epub Nov. 6, 2006.

International Preliminary Report on Patentability for PCT/US2012/047778, dated Feb. 6, 2014.

International Preliminary Report on patentability for PCT/US2014/050283, dated Feb. 18, 2016.

International Preliminary Report on Patentability for PCT/US2014/052231, dated Mar. 3, 2016.

International Preliminary Report on Patentability for PCT/US2014/054247, dated Mar. 17, 2016.

International Preliminary Report on Patentability for PCT/US2014/054291, dated Mar. 17, 2016.

International Preliminary Report on Patentability for PCT/US2014/070038, dated Jun. 23, 2016.

International Preliminary Report on Patentability for PCT/US2015/042770, dated Dec. 19, 2016.

International Preliminary Report on Patentability for PCT/US2015/058479, dated May 11, 2017.

International Preliminary Report on Patentability for PCT/US2014/054252, dated Mar. 17, 2016.

International Search Report and Written Opinion for PCT/US2012/047778, dated May 30, 2013.

International Search Report and Written Opinion for PCT/US2014/050283, dated Nov. 6, 2014.

International Search Report and Written Opinion for PCT/US2014/052231, dated Dec. 4, 2014.

International Search Report and Written Opinion for PCT/US2014/052231, dated Jan. 30, 2015 (Corrected Version).

International Search Report and Written Opinion for PCT/US2014/054247, dated Mar. 27, 2015.

International Search Report and Written Opinion for PCT/US2014/054252, dated Mar. 5, 2015.

International Search Report and Written Opinion for PCT/US2014/054291, dated Mar. 27, 2015.

International Search Report and Written Opinion for PCT/US2014/070038, dated Apr. 14, 2015.

International Search Report and Written Opinion for PCT/US2015/042770, dated Feb. 23, 2016.

International Search Report and Written Opinion for PCT/US2015/058479, dated Feb. 11, 2016.

International Search Report and Written Opinion for PCT/US2016/044546, dated Dec. 28, 2016.

International Search Report and Written Opinion for PCT/US2016/058344, dated Apr. 20, 2017.

International Search Report and Written Opinion for PCT/US2017/045381, dated Oct. 26, 2017.

International Search Report and Written Opinion for PCT/US2017/046144, dated Oct. 10, 2017.

International Search Report and Written Opinion for PCT/US2017/48390, dated Jan. 9, 2018.

International Search Report for PCT/US2013/032589, dated Jul. 26, 2013.

Invitation to Pay Additional Fees for PCT/US2014/054291, dated Dec. 18, 2014.

Invitation to Pay Additional Fees for PCT/US2016/058344, dated Mar. 1, 2017.

Invitation to Pay Additional Fees for PCT/US2017/056671, dated Dec. 21, 2017.

Invitation to Pay Additional Fees for PCT/US2017/48390, dated Nov. 7, 2017.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.

Joung et al., TALENs: a widely applicable technology for targeted genome editing. Nat Rev Mol Cell Biol. Jan. 2013;14(1):49-55. doi: 10.1038/nrm3486. Epub Nov. 21, 2012.

Kaiser et al., Gene therapy. Putting the fingers on gene repair. Science. Dec. 23, 2005;310(5756):1894-6.

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

(56) References Cited

OTHER PUBLICATIONS

Kappel et al., Regulating gene expression in transgenic animals. Curr Opin Biotechnol. Oct. 1992;3(5):548-53.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Kaya et al., A bacterial Argonaute with noncanonical guide RNA specificity. Proc. Natl. Acad. Sci. USA Apr. 2016;113(15):4057-62.

Kellendonk et al., Regulation of Cre recombinase activity by the synthetic steroid RU 486. Nucleic Acids Res. Apr. 15, 1996;24(8):1404-11.

Kim et al., A library of TAL effector nucleases spanning the human genome. Nat Biotechnol. Mar. 2013;31(3):251-8. Doi: 10.1038/nbt.2517. Epub Feb. 17, 2013.

Kim et al., Genome-wide target specificities of CRISPR RNA-guided programmable deaminases. Nat Biotechnol. May 2017;35(5):475-480. doi: 10.1038/nbt.3852. Epub Apr. 10, 2017.

Kim et al., Highly efficient RNA-guided base editing in mouse embryos. Nat Biotechnol. May 2017;35(5):435-437. doi: 10.1038/nbt.3816. Epub Feb. 27, 2017.

Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.

Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.

Kim et al., TALENs and ZFNs are associated with different mutationsignatures. Nat Methods. Mar. 2013;10(3):185. doi: 10.1038/nmeth.2364. Epub Feb. 10, 2013.

Kim et al., Targeted genome editing in human cells with zinc finger nucleases constructed via modular assembly. Genome Res. Jul. 2009;19(7):1279-88. doi: 10.1101/gr.089417.108. Epub May 21, 2009.

Kim et al., The role of apolipoprotein E in Alzheimer's disease. Neuron. Aug. 13, 2009;63(3):287-303. doi: 10.1016/j.neuron.2009.06.026.

Kim et al., Transcriptional repression by zinc finger peptides. Exploring the potential for applications in gene therapy. J Biol Chem. Nov. 21, 1997;272(47):29795-800.

Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.

Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.

Klippel et al., Isolation and characterization of unusual gin mutants. EMBO J. Dec. 1, 1988;7(12):3983-9.

Klippel et al., The DNA invertase Gin of phage Mu: formation of a covalent complex with DNA via a phosphoserine at amino acid position 9. EMBO J. Apr. 1988;7(4):1229-37.

Komor et al., Programmable editing of a target base in genomic DNA without double-stranded DNA cleavage. Nature. Apr. 20, 2016;533(7603):420-4. doi: 10.1038/nature17946.

Kumar et al., Structural and functional consequences of the mutation of a conserved arginine residue in alphaA and alphaB crystallins. J Biol Chem. Aug. 20, 1999;274(34):24137-41.

Kundu et al., Leucine to proline substitution by SNP at position 197 in Caspase-9 gene expression leads to neuroblastoma: a bioinformatics analysis. 3 Biotech. 2013; 3:225-34.

Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lazar et al., Transforming growth factor alpha: mutation of aspartic acid 47 and leucine 48 results in different biological activities. Mol Cell Biol. Mar. 1988;8(3):1247-52.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lei et al., Efficient targeted gene disruption in Xenopus embryos using engineered transcription activator-like effector nucleases (TALENs). Proc Natl Acad Sci U S A. Oct. 23, 2012;109(43)17484-9. Doi: 10.1073/pnas.1215421109. Epub Oct. 8, 2012.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Codon 129 polymorphism of the human prion protein influences the kinetics of amyloid formation. J Gen Virol. Aug. 2006;87(Pt 8):2443-9.

Li et al., Current approaches for engineering proteins with diverse biological properties. Adv Exp Med Biol. 2007;620:18-33.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

(56) References Cited

OTHER PUBLICATIONS

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Lin et al., Enhanced homology-directed human genome engineering by controlled timing of CRISPR/Cas9 delivery. Elife. Dec. 15, 2014;3:e04766. doi: 10.7554/eLife.04766.

Liu et al., C2c1-sgRNA Complex Structure Reveals RNA-Guided DNA Cleavage Mechanism. Molecular Cell Jan. 2017;65(2):310-22.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Design of polydactyl zinc-finger proteins for unique addressing within complex genomes. Proc Natl Acad Sci U S A. May 27, 1997;94(11):5525-30.

Liu et al., Fast Colorimetric Sensing of Adenosine and Cocaine Based on a General Sensor Design Involving Aptamers and Nanoparticles. Angew Chem. 2006;118(1):96-100.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Losey et al., Crystal structure of *Staphylococcus sureus* tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Ma et al., Targeted AID-mediated mutagenesis (TAM) enables efficient genomic diversification in mammalian cells. Nature Methods. Oct. 2016;13:1029-35. doi:10.1038/nmeth.4027.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Mali et al., Cas9 as a versatile tool for engineering biology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mol et al., Crystal structure of human uracil-DNA glycosylase in complex with a protein inhibitor: protein mimicry of DNA. Cell. Sep. 8, 1995;82(5):701-8.

Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mullins et al., Transgenesis in nonmurine species. Hypertension. Oct. 1993;22(4):630-3.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Nahvi et al., Coenzyme B12 riboswitches are widespread genetic control elements in prokaryotes. Nucleic Acids Res. Jan. 2, 2004;32(1):143-50.

(56) References Cited

OTHER PUBLICATIONS

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
Offord, Advances in Genome Editing. The Scientist, Apr. 20, 2016. http://www.the-scientist.com/?articles.view/articleNo/45903/title/Advances-in-Genome-Editing/.
Osborn et al., TALEN-based gene correction for epidermolysis bullosa. Mol Ther. Jun. 2013;21(6):1151-9. doi: 10.1038/mt.2013.56. Epub Apr. 2, 2013.
Pan et al., Biological and biomedical applications of engineered nucleases. Mol Biotechnol. Sep. 2013;55(1):54-62. doi: 10.1007/s12033-012-9613-9.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Partial Supplementary European Search Report for Application No. EP 12845790.0, dated Mar. 18, 2015.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Petek et al., Frequent endonuclease cleavage at off-target locations in vivo. Mol Ther. May 2010;18(5):983-6. Doi: 10.1038/mt.2010.35. Epub Mar. 9, 2010.

Petolino et al., Editing Plant Genomes: a new era of crop improvement. Plant Biotechnol J. Feb. 2016;14(2):435-6. doi: 10.1111/pbi.12542.
Phillips, The challenge of gene therapy and DNA delivery. J Pharm Pharmacol. Sep. 2001;53(9):1169-74.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Porteus, Design and testing of zinc finger nucleases for use in mammalian cells. Methods Mol Biol. 2008;435:47-61. doi: 10.1007/978-1-59745-232-8_4.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Rebuzzini et al., New mammalian cellular systems to study mutations introduced at the break site by non-homologous end-joining. DNA Repair (Amst). May 2, 2005;4(5):546-55.

(56) References Cited

OTHER PUBLICATIONS

Rees et al., Improving the DNA specificity and applicability of base editing through protein engineering and protein delivery. Nat Commun. Jun. 6, 2017;8:15790. doi: 10.1038/ncomms15790.

Reyon et al., Flash assembly of TALENs for high-throughput genome editing. Nat Biotechnol. May 2012;30(5):460-5. doi: 10.1038/nbt.2170.

Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.

Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.

Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

Sadelain et al., Safe harbours for the integration of new DNA in the human genome. Nat Rev Cancer. Dec. 1, 2011;12(1):51-8. doi: 10.1038/nrc3179.

Sage et al., Proliferation of functional hair cells in vivo in the absence of the retinoblastoma protein. Science. Feb. 18, 2005;307(5712):1114-8. Epub Jan. 13, 2005.

Samal et al., Cationic polymers and their therapeutic potential. Chem Soc Rev. Nov. 7, 2012;41(21):7147-94. doi: 10.1039/c2cs35094g. Epub Aug. 10, 2012.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Sang, Prospects for transgenesis in the chick. Mech Dev. Sep. 2004;121(9):1179-86.

Sanjana et al., A transcription activator-like effector toolbox for genome engineering. Nat Protoc. Jan. 5, 2012;7(1):171-92. doi: 10.1038/nprot.2011.431.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

Schriefer et al., Low pressure DNA shearing: a method for random DNA sequence analysis. Nucleic Acids Res. Dec. 25, 1990;18(24):7455-6.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Schwartz et al., Post-translational enzyme activation in an animal via optimized conditional protein splicing. Nat Chem Biol. Jan. 2007;3(1):50-4. Epub Nov. 26, 2006.

Schwarze et al., In vivo protein transduction: delivery of a biologically active protein into the mouse. Science. Sep. 3, 1999;285(5433):1569-72.

Sclimenti et al., Directed evolution of a recombinase for improved genomic integration at a native human sequence. Nucleic Acids Res. Dec. 15, 2001;29(24):5044-51.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Sells et al., Delivery of protein into cells using polycationic liposomes. Biotechniques. Jul. 1995;19(1):72-6, 78.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Semple et al., Rational design of cationic lipids for siRNA delivery. Nat Biotechnol. Feb. 2010;28(2):172-6. doi: 10.1038/nbt.1602. Epub Jan. 17, 2010.

Seripa et al., The missing ApoE allele. Ann Hum Genet. Jul. 2007;71(Pt 4):496-500. Epub Jan. 22, 2007.

Shah et al., Inteins: nature's gift to protein chemists. Chem Sci. 2014;5(1):446-461.

Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.

Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.

Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.

Shmakov et al., Discovery and Functional Characterization of Diverse Class 2 CRISPR Cas Systems. Molecular Cell Nov. 2015;60(3):385-97.

Siebert et al., An improved PCR method for walking in uncloned genomic DNA. Nucleic Acids Res. Mar. 25, 1995;23(6):1087-8.

Simonelli et al., Base excision repair intermediates are mutagenic in mammalian cells. Nucleic Acids Res. Aug. 2, 2005;33(14):4404-11. Print 2005.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Sjoblom et al., The consensus coding sequences of human breast and colorectal cancers. Science. Oct. 13, 2006;314(5797):268-74. Epub Sep. 7, 2006.

Slaymaker et al., Rationally engineered Cas9 nucleases with improved specificity. Science. Jan. 1, 2016;351(6268):84-8. doi: 10.1126/science.aad5227. Epub Dec. 1, 2015.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

(56) References Cited

OTHER PUBLICATIONS

Sternberg et al., DNA interrogation by the CRISPR RNA-guided endonuclease Cas9. Nature. Mar. 6, 2014;507(7490):62-7. doi: 10.1038/nature13011. Epub Jan. 29, 2014.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Supplementary European Search Report for Application No. EP 12845790.0, dated Oct. 12, 2015.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tagalakis et al., Lack of RNA-DNA oligonucleotide (chimeraplast) mutagenic activity in mouse embryos. Mol Reprod Dev. Jun. 2005;71(2):140-4.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12-396962-0.00012-4.
Thorpe et al., Functional correction of episomal mutations with short DNA fragments and RNA-DNA oligonucleotides. J Gene Med. Mar.-Apr. 2002;4(2):195-204.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., GUIDE-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vitreschak et al., Regulation of the vitamin B12 metabolism and transport in bacteria by a conserved RNA structural element. RNA. Sep. 2003;9(9):1084-97.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2)1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.

(56) References Cited

OTHER PUBLICATIONS

Weber et al., Assembly of designer TAL effectors by Golden Gate cloning. PLoS One. 2011;6(5):e19722. doi:10.1371/journal.pone.0019722. Epub May 19, 2011.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wolfe et al., Analysis of zinc fingers optimized via phage display: evaluating the utility of a recognition code. J Mol Biol. Feb. 5, 1999;285(5)1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., PAM-dependent Target DNA Recognition and Cleavage by C2C1 CRISPR-Cas endonuclease. Cell Dec. 2016;167(7):1814-28.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Programmable base editing of zebrafish genome using a modified CRISPR-Cas9 system. Nat Commun. Jul. 25, 2017;8(1):118. doi: 10.1038/s41467-017-00175-6.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zuris et al., Cationic lipid-mediated delivery of proteins enables efficient protein-based genome editing in vitro and in vivo. Nat Biotechnol. 2015;33:73-80.

* cited by examiner

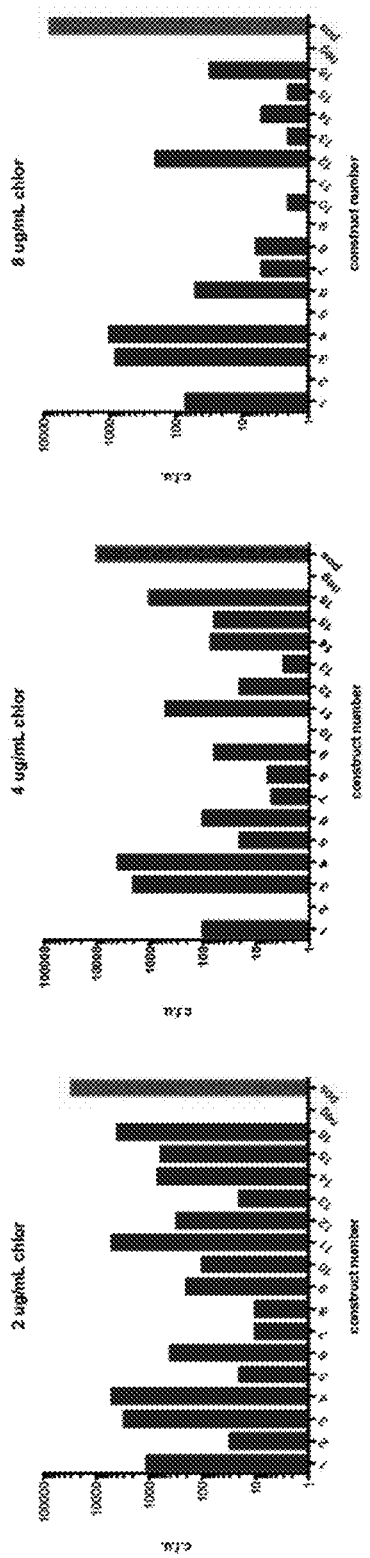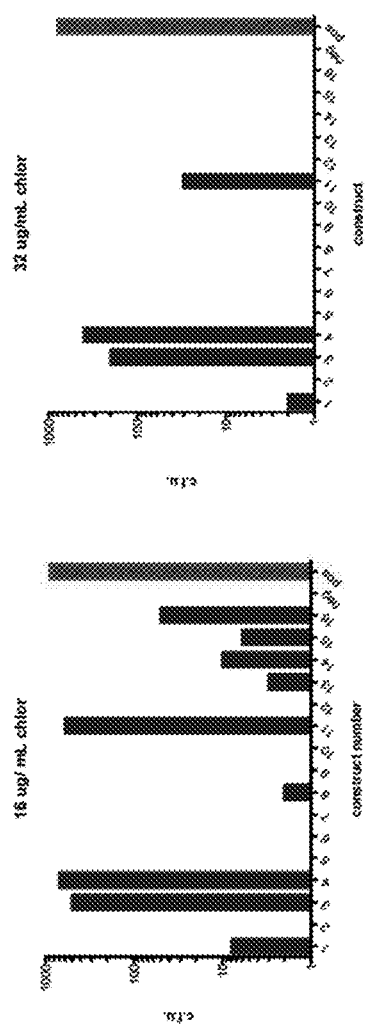
FIGURE 12

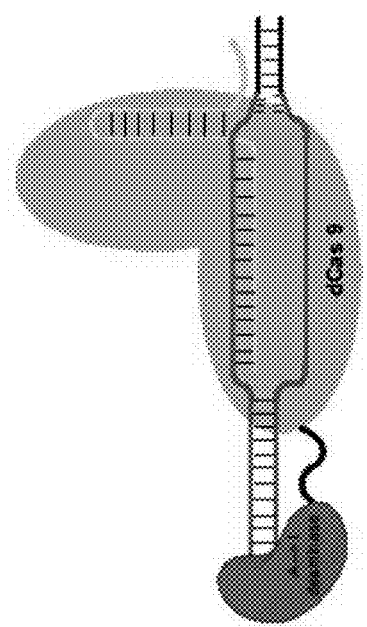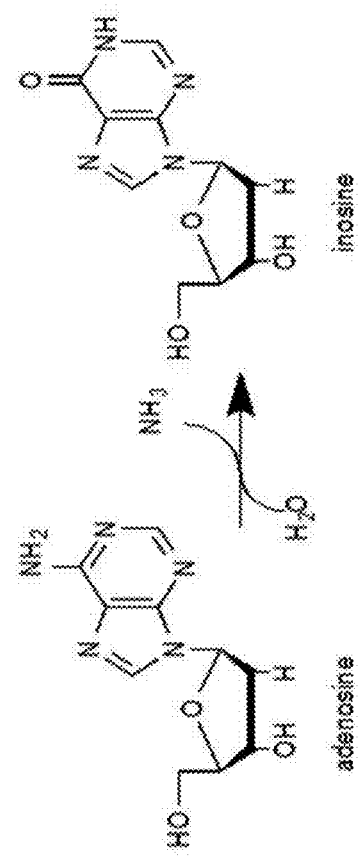
FIGURE 15

| position: | 8 | 26 | 61 | 68 | 70 | 106 | 107 | 108 | 109 | 127 | 147 | 152 | 154 | 155 | 161 | 163 | 166 |
|---|---|---|---|---|---|---|---|---|---|---|---|---|---|---|---|---|---|
| wt residue | His | Arg | Met | Leu | Met | Ala | Arg | Asn | Ala | Asn | Asn | Arg | Gln | L | Leu | Gln | Thr |
| 1 pNMG-149 | Tyr | | | | | | | | | Ser | | | | | | | |
| 2 pNMG-150 | Tyr | | Ile | | Val | | | Asn | | Ser | Tyr | Cys | His | Gly | | | |
| 3 pNMG-151 | Tyr | | | | | | | Asn | | Ser | | | Arg | Val | | His | |
| 4 pNMG-152 | Tyr | | | Gln | | Thr | | Asn | | Ser | | | | Asp | Gln | | Pro |
| 5 pNMG-153 | Tyr | Trp | | | | | | Asn | | Ser | Tyr | | | Val | | | |
| 6 pNMG-154 | Tyr | | | | | | | Asn | Thr | Ser | | | | Gly | | | |

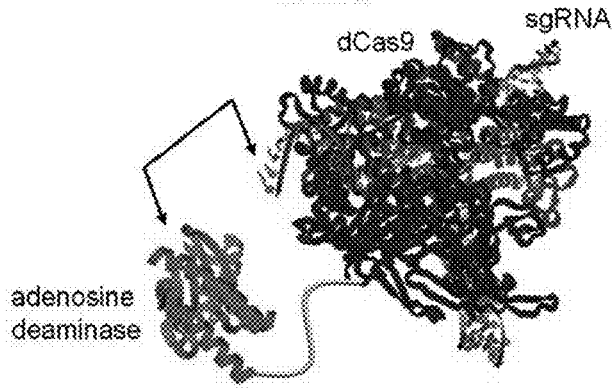

FIGURE 47

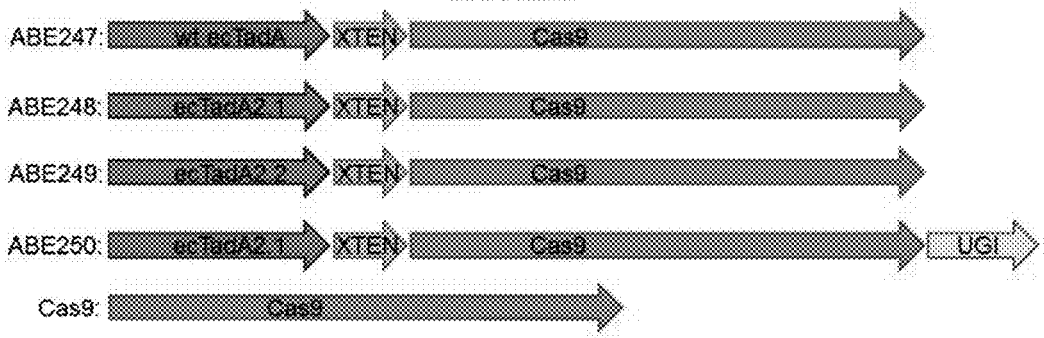

FIGURE 48

|        | EMX1  | FANCF | HEK2  | HEK3  | HEK4  | RNF2  |
|--------|-------|-------|-------|-------|-------|-------|
| wtCas9 | 35.4% | 37.0% | 32.9% | 56.8% | 23.8% | 33.8% |
| ABE247 | 25.5% | 30.2% | 45.7% | 76.3% | 36.5% | 26.8% |
| ABE248 | 24.8% | 26.6% | 39.8% | 64.2% | 35.1% | 26.5% |
| ABE249 | 30.2% | 28.6% | 42.0% | 66.7% | 40.0% | 27.1% |
| ABE250 | 25.0% | 25.2% | 31.3% | 56.3% | 36.4% | 25.2% |

FIGURE 49

```
              protospacer                    PAM
              ─────────────────────────────  ───
EMX1:         GA₅GTCCGA₈GCAGAAGAAGAAGGG
FANCF:        GGA₃A₄TCCCTTCTGCAGCACCTGG
HEK293 site 2: GA₂A₃CA₅CA₇A₈A₉GCATAGACTGCGGG
HEK293 site 3: GGCCCA₆GA₈CTGAGCACGTGATGG
HEK293 site 4: GGCA₄CTGCGGCTGGAGGTCCGGG
RNF2:         GTCA₄TCTTA₉GTCATTACCTGAGG
```

HEK293 site 2: GA₂A₃CA₅CA₇A₈A₉GCATAGACTGCGGG (see high editing at A-5)

EMX1: GA₃GTCCGA₆GCAGAAGAAGAAGGG (see no editing)

HEK293 site 3: GGCCCA₆GA₈CTGAGCACGTGATGG (see low editing)

HEK293 site 2:   GA$_2$A$_3$CA$_5$CA$_7$A$_6$A$_9$GCATAGACTGCGGG

RNF2 multi-A:    A$_1$GA$_3$A$_4$A$_5$A$_6$A$_7$CA$_9$A$_{10}$TTTTAGTATTTGG

HEK3 multi-A:    GCA$_3$GA$_5$A$_6$A$_7$TA$_9$GA$_{11}$CTAATTGCATGG

FIGURE 59

| HEK2 | | $A_2$ | $A_3$ | $A_5$ | $A_7$ | $A_8$ | $A_9$ |
|---|---|---|---|---|---|---|---|
| untreated | A | 100 | 100 | 100 | 100 | 100 | 100 |
| | C | 0 | 0 | 0 | 0 | 0 | 0 |
| | G | 0 | 0 | 0 | 0 | 0 | 0 |
| | T | 0 | 0 | 0 | 0 | 0 | 0 |
| XTEN | A | 100 | 99.8 | 90.6 | 100 | 100 | 100 |
| | C | 0 | 0 | 0 | 0 | 0 | 0 |
| | G | 0 | 0.2 | 9.4 | 0 | 0 | 0 |
| | T | 0 | 0 | 0 | 0 | 0 | 0 |
| | | 0 | 0 | 0 | 0 | 0 | 0 |
| GGS | A | 100 | 99.9 | 87.7 | 100 | 100 | 100 |
| | C | 0 | 0 | 0 | 0 | 0 | 0 |
| | G | 0 | 0.1 | 12.3 | 0 | 0 | 0 |
| | T | 0 | 0 | 0 | 0 | 0 | 0 |
| (GGS)$_2$XTEN(GGS)$_2$ | A | 100 | 99.9 | 77.6 | 100 | 100 | 100 |
| | C | 0 | 0 | 0 | 0 | 0 | 0 |
| | G | 0 | 0.1 | 22.4 | 0 | 0 | 0 |
| | T | 0 | 0 | 0 | 0 | 0 | 0 |

FIGURE 60

| | | EMX1 $A_5$ | $A_6$ | FANCF $A_5$ | $A_6$ | HEK3 $A_5$ | $A_6$ | HEK4 $A_4$ | RNF2 $A_4$ | $A_5$ |
|---|---|---|---|---|---|---|---|---|---|---|
| untreated | A | 100.0 | 100.0 | 100.0 | 100.0 | 100.0 | 100.0 | 100 | 100.0 | 100.0 |
| | C | 0.0 | 0.0 | 0.0 | 0.0 | 0.0 | 0.0 | 0 | 0.0 | 0.0 |
| | G | 0.0 | 0.0 | 0.0 | 0.0 | 0.0 | 0.0 | 0 | 0.0 | 0.0 |
| | T | 0.0 | 0.0 | 0.0 | 0.0 | 0.0 | 0.0 | 0 | 0.0 | 0.0 |
| XTEN (pJW-164: pCMV_scT7adA_XTEN_Cas9n_GGS_NLS; C082N_D147Y_E155V) | A | 100.0 | 100.0 | 100.0 | 100.0 | 99.8 | 99.4 | 99.7 | 99.9 | 99.9 |
| | C | 0.0 | 0.0 | 0.0 | 0.0 | 0.0 | 0.0 | 0.0 | 0.0 | 0.0 |
| | G | 0.0 | 0.0 | 0.0 | 0.0 | 0.2 | 0.6 | 0.3 | 0.0 | 0.1 |
| | T | 0.0 | 0.0 | 0.0 | 0.0 | 0.0 | 0.0 | 0.0 | 0.0 | 0.0 |
| GGS (pJW-162: pCMV_scT7adA_GGS_Cas9n_GGS_NLS; C082N_D147Y_E155V) | A | 100.0 | 100.0 | 100.0 | 99.8 | 99.7 | 99.8 | 99.5 | 99.9 | 100.0 |
| | C | 0.0 | 0.0 | 0.0 | 0.0 | 0.0 | 0.0 | 0.0 | 0.0 | 0.0 |
| | G | 0.0 | 0.0 | 0.0 | 0.2 | 0.2 | 0.2 | 0.4 | 0.0 | 0.0 |
| | T | 0.0 | 0.0 | 0.0 | 0.0 | 0.0 | 0.0 | 0.0 | 0.0 | 0.0 |
| (GGS)$_2$XTEN(GGS)$_2$ (pJW-153/pCMV_scTadA_(GGS)$_2$XTEN_(GGS)$_2$_Cas9n_GGS_NLS; C082N_D147Y_E155V) | A | 100.0 | 99.8 | 100.0 | 99.9 | 99.8 | 99.9 | 99.4 | 99.9 | 99.9 |
| | C | 0.0 | 0.0 | 0.0 | 0.0 | 0.0 | 0.0 | 0.0 | 0.0 | 0.0 |
| | G | 0.0 | 0.2 | 0.0 | 0.1 | 0.2 | 1.0 | 0.6 | 0.1 | 0.1 |
| | T | 0.0 | 0.0 | 0.0 | 0.0 | 0.0 | 0.0 | 0.0 | 0.0 | 0.0 |

HEK293 site 2: GA$_1$A$_2$CA$_3$CA$_4$A$_5$A$_6$GCATAGACTGCGGG
(showing as T to C)

FANCF:  GGA$_3$A$_4$TCCTTCTGCAGCACCTGG

Run # 2:

FIGURE 75

| 142 (pCMV_ecTadA_XTEN_Cas9n_GGS_NLS; wild-type) parental | A$_3$ | A$_4$ | 142 (pCMV_ecTadA_XTEN_Cas9n_GGS_NLS; wild-type) out | A$_3$ | A$_4$ | 142 (pCMV_ecTadA_XTEN_Cas9n_GGS_NLS; wild-type) out | A$_3$ | A$_4$ |
|---|---|---|---|---|---|---|---|---|
| A | 100.0 | 100.0 | A | 100.0 | 100.0 | A | 100.0 | 100.0 |
| C | 0.0 | 0.0 | C | 0.0 | 0.0 | C | 0.0 | 0.0 |
| G | 0.0 | 0.0 | G | 0.0 | 0.0 | G | 0.0 | 0.0 |
| T | 0.0 | 0.0 | T | 0.0 | 0.0 | T | 0.0 | 0.0 |
| 177 (pCMV_ecTadA_XTEN_Cas9n_GGS_NLS; A106V_D108N_D147Y_E155V) | | | 177 (pCMV_ecTadA_XTEN_Cas9n_GGS_NLS; A106V_D108N_D147Y_E155V) | | | 177 (pCMV_ecTadA_XTEN_Cas9n_GGS_NLS; A106V_D108N_D147Y_E155V) | | |
| A | 100.0 | 99.7 | A | 100.0 | 99.8 | A | 99.9 | 99.8 |
| C | 0.0 | 0.0 | C | 0.0 | 0.0 | C | 0.0 | 0.0 |
| G | 0.0 | 0.3 | G | 0.0 | 0.2 | G | 0.1 | 0.2 |
| T | 0.0 | 0.0 | T | 0.0 | 0.0 | T | 0.0 | 0.0 |
| 179 (pCMV_ecTadA_XTEN_Cas9n_GGS_AAG*(E125Q)_GGS_NLS; A106V_D108N_D147Y_E155V) | | | 179 (pCMV_ecTadA_XTEN_Cas9n_GGS_AAG*(E125Q)_GGS_NLS; A106V_D108N_D147Y_E155V) | | | 179 (pCMV_ecTadA_XTEN_Cas9n_GGS_AAG*(E125Q)_GGS_NLS; A106V_D108N_D147Y_E155V) | | |
| A | 100.0 | 100.0 | A | 100.0 | 99.9 | A | 100.0 | 99.9 |
| C | 0.0 | 0.0 | C | 0.0 | 0.0 | C | 0.0 | 0.0 |
| G | 0.0 | 0.0 | G | 0.0 | 0.1 | G | 0.0 | 0.0 |
| T | 0.0 | 0.0 | T | 0.0 | 0.0 | T | 0.0 | 0.0 |
| 180 (pCMV_ecTadA_XTEN_Cas9n_GGS_UGI_GGS_NLS; A106V_D108N_D147Y_E155V) | | | 180 (pCMV_ecTadA_XTEN_Cas9n_GGS_UGI_GGS_NLS; A106V_D108N_D147Y_E155V) | | | 180 (pCMV_ecTadA_XTEN_Cas9n_GGS_UGI_GGS_NLS; A106V_D108N_D147Y_E155V) | | |
| A | 100.0 | 99.8 | A | 100.0 | 100.0 | A | 100.0 | 99.9 |
| C | 0.0 | 0.0 | C | 0.0 | 0.0 | C | 0.0 | 0.0 |
| G | 0.0 | 0.2 | G | 0.0 | 0.0 | G | 0.0 | 0.1 |
| T | 0.0 | 0.0 | T | 0.0 | 0.0 | T | 0.0 | 0.0 |

| HEK2 | | $A_2$ | $A_3$ | $A_5$ | $A_7$ | $A_8$ | $A_9$ |
|---|---|---|---|---|---|---|---|
| 177 (pCMV_ecTadA_XTEN_Cas9n_GGS_NLS; A106V_D108N_D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 238 (pCMV_AAG*(E125A)_XTEN_ecTadA_XTEN_Cas9n_GGS_NLS; A106V_D108N_D147Y_E15 | A | 100.0 | 99.9 | 74.8 | 99.9 | 100.0 | 100.0 |
| | C | 0.0 | 0.0 | 0.0 | 0.0 | 0.0 | 0.0 |
| | G | 0.0 | 0.1 | 25.2 | 0.1 | 0.0 | 0.0 |
| | T | 0.0 | 0.0 | 0.0 | 0.0 | 0.0 | 0.0 |
| 239 (pCMV_AAG*(wt)_XTEN_ecTadA_XTEN_Cas9n_GGS_NLS; A106V_D108N_D147Y_E15 | A | 100.0 | 99.8 | 69.0 | 99.9 | 99.9 | 100.0 |
| | C | 0.0 | 0.0 | 0.1 | 0.0 | 0.0 | 0.0 |
| | G | 0.0 | 0.2 | 30.9 | 0.1 | 0.1 | 0.0 |
| | T | 0.0 | 0.0 | 0.0 | 0.0 | 0.0 | 0.0 |

FIGURE 86
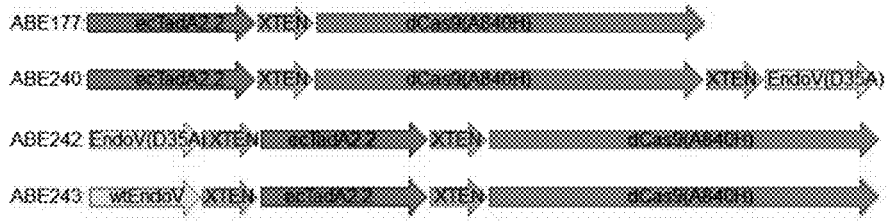
FIGURE 87
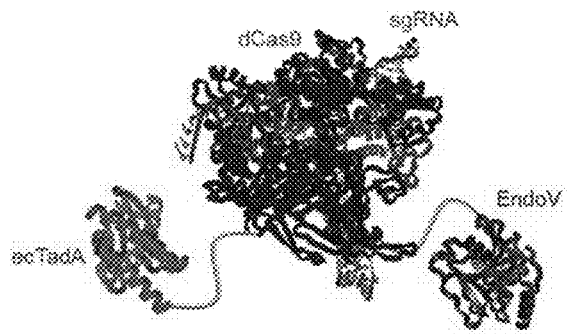
FIGURE 88
| HEK2 | | A₂ | A₃ | A₅ | A₇ | A₈ | A₉ |
|---|---|---|---|---|---|---|---|
| 177 (pCMV_ecTadA_ XTEN_Cas9n_G GS_NLS; A106V_D108N_ D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 240 (pCMV_ecTadA_ XTEN_Cas9n_XT EN_EndoV*(D35 A)_GGS_NLS; A106V_D108N_ D147Y_E155V) | A | 100.0 | 99.7 | 64.8 | 99.9 | 99.9 | 99.9 |
| | C | 0.0 | 0.0 | 0.0 | 0.0 | 0.0 | 0.0 |
| | G | 0.0 | 0.3 | 35.2 | 0.1 | 0.1 | 0.1 |
| | T | 0.0 | 0.0 | 0.0 | 0.0 | 0.0 | 0.0 |
| 242 (pCMV_EndoV*( D35A)_XTEN_ec TadA_XTEN_Cas 9n_GGS_NLS; A106V_D108N_ D147Y_E155V) | A | 100.0 | 99.8 | 53.8 | 100.0 | 99.9 | 100.0 |
| | C | 0.0 | 0.0 | 0.0 | 0.0 | 0.0 | 0.0 |
| | G | 0.0 | 0.1 | 46.2 | 0.0 | 0.1 | 0.0 |
| | T | 0.0 | 0.0 | 0.0 | 0.0 | 0.0 | 0.0 |
| 243 (pCMV_EndoV*( wt)_XTEN_ecTad A_XTEN_Cas9n_ GGS_NLS; A106V_D108N_ D147Y_E155V) | A | 100.0 | 99.9 | 67.8 | 99.9 | 99.9 | 100.0 |
| | C | 0.0 | 0.5 | 0.0 | 0.5 | 0.1 | 0.0 |
| | G | 0.0 | 0.1 | 32.0 | 0.0 | 0.0 | 0.0 |
| | T | 0.0 | 0.0 | 0.0 | 0.0 | 0.0 | 0.0 |

| wt res | S2 | H8 | I49 | L84 | A106 | D108 | H123 | N127 | D147 | E155 | I156 | K160 |
|---|---|---|---|---|---|---|---|---|---|---|---|---|
| clone 1 | | | | Phe | Val | Arg | Tyr | | Tyr | Val | Phe | |
| clone 2 | Ala | | Phe | Val | | Arg | | | Tyr | Val | | |
| clone 3 | | Tyr | | Thr | | Arg | | Ser | Asp | Glu | | Ser |

| HEK2 | G | A | A | C | A | C | A | A | A | G |
|---|---|---|---|---|---|---|---|---|---|---|
| 339 | | 0.1% | 5.0% | | | | 1.6% | 1.9% | 0.9% | |
| 340 | | 0.1% | 2.6% | | | | 0.5% | 1.1% | 0.6% | |
| 341 | | 0.1% | 6.0% | | | | 1.7% | 1.6% | 1.1% | |

| HEK2 | G | G | A | A | C | A | C | A | A | A |
|---|---|---|---|---|---|---|---|---|---|---|
| 339 | | 2.2% | | | | | | 6.6% | 23.3% | 2.1% |
| 340 | | 1.4% | 31.0% | | | 35.0% | | 2.6% | 19.6% | 1.5% |
| 341 | | 1.9% | | | | | | 5.7% | 18.1% | 2.0% |

| HEK2-3 | G | T | A | A | A | C | A | A | A | G |
|---|---|---|---|---|---|---|---|---|---|---|
| 339 | | 0.5% | 1.0% | 19.3% | | | 0.6% | 1.5% | 0.7% | |
| 340 | | 0.2% | 0.4% | 17.2% | | | 0.2% | 0.7% | 0.3% | |
| 341 | | 0.5% | 1.0% | 19.5% | | | 0.6% | 1.3% | 0.5% | |

| HEK2-6 | G | A | A | G | A | C | C | A | A | G |
|---|---|---|---|---|---|---|---|---|---|---|
| 339 | | 0.0% | 0.1% | | 7.2% | | | 0.4% | 0.3% | |
| 340 | | 0.0% | 0.0% | | 6.1% | | | 0.2% | 0.1% | |
| 341 | | 0.0% | 0.0% | | 6.6% | | | 0.4% | 0.3% | |

| HEK2-7 | G | A | A | A | A | C | A | A | A | T |
|---|---|---|---|---|---|---|---|---|---|---|
| 339 | | 0.0% | 0.0% | 0.0% | 0.6% | | 0.0% | 0.0% | 0.0% | |
| 340 | | 0.0% | 0.0% | 0.0% | 0.3% | | 0.0% | 0.0% | 0.0% | |
| 341 | | 0.0% | 0.0% | 0.0% | 0.4% | | 0.1% | 0.0% | 0.0% | |

| HEK2-8 | G | A | T | C | A | C | A | A | A | G |
|---|---|---|---|---|---|---|---|---|---|---|
| 339 | | 0.2% | | | 23.9% | | 0.5% | 0.5% | 0.3% | |
| 340 | | 0.1% | | | 35.0% | | 0.2% | 0.2% | 0.1% | |
| 341 | | 0.2% | | | 27.5% | | 0.5% | 0.4% | 0.3% | |

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-369 | | 2 A | 3 A | 5 A | 7 A | 8 A | 9 A | 12 A | 14 A | 16 A |
|---|---|---|---|---|---|---|---|---|---|---|
| Evo #3 | A | 99.92% | 97.44% | [hi] | 99.03% | 99.17% | 99.59% | 99.96% | 99.97% | 100.0% |
| | C | 0.00% | 0.00% | 0.01% | 0.00% | 0.00% | 0.00% | 0.00% | 0.00% | 0.0% |
| | G | 0.07% | 2.56% | [hi] | 0.96% | 0.83% | 0.41% | 0.03% | 0.02% | 0.0% |
| | T | 0.00% | 0.01% | 0.02% | 0.01% | 0.00% | 0.00% | 0.01% | 0.00% | 0.0% |

| HEK2 pNMG-370 | | 2 A | 3 A | 5 A | 7 A | 8 A | 9 A | 12 A | 14 A | 16 A |
|---|---|---|---|---|---|---|---|---|---|---|
| Evo #2 | A | 99.96% | 98.55% | [hi] | 99.71% | 99.40% | 99.80% | 99.96% | 99.97% | 100.0% |
| | C | 0.00% | 0.00% | 0.00% | 0.00% | 0.00% | 0.00% | 0.00% | 0.00% | 0.0% |
| | G | 0.05% | 1.44% | [hi] | 0.29% | 0.59% | 0.20% | 0.03% | 0.02% | 0.0% |
| | T | 0.01% | 0.01% | 0.02% | 0.00% | 0.00% | 0.00% | 0.01% | 0.00% | 0.0% |

| HEK2 pNMG-371 | | 2 A | 3 A | 5 A | 7 A | 8 A | 9 A | 12 A | 14 A | 16 A |
|---|---|---|---|---|---|---|---|---|---|---|
| Evo #3 | A | 99.91% | 96.97% | [hi] | 99.11% | 99.06% | 99.41% | 99.96% | 99.96% | 100.0% |
| | C | 0.00% | 0.00% | 0.00% | 0.00% | 0.00% | 0.00% | 0.00% | 0.00% | 0.0% |
| | G | 0.09% | 3.02% | [hi] | 0.89% | 0.93% | 0.59% | 0.03% | 0.01% | 0.0% |
| | T | 0.00% | 0.00% | 0.01% | 0.00% | 0.00% | 0.00% | 0.01% | 0.00% | 0.0% |

| HEK2 pNMG-360 | | 2 A | 3 A | 5 A | 7 A | 8 A | 9 A | 12 A | 14 A | 16 A |
|---|---|---|---|---|---|---|---|---|---|---|
| Evo #4 | A | 99.92% | 98.69% | [hi] | 99.68% | 99.71% | 99.92% | 99.95% | 99.97% | 100.0% |
| | C | 0.00% | 0.00% | 0.01% | 0.00% | 0.00% | 0.00% | 0.00% | 0.00% | 0.0% |
| | G | 0.07% | 1.30% | [hi] | 0.32% | 0.28% | 0.07% | 0.04% | 0.02% | 0.0% |
| | T | 0.01% | 0.00% | 0.01% | 0.00% | 0.01% | 0.00% | 0.00% | 0.00% | 0.0% |

| HEK2 pNMG-361 | | 2 A | 3 A | 5 A | 7 A | 8 A | 9 A | 12 A | 14 A | 16 A |
|---|---|---|---|---|---|---|---|---|---|---|
| Evo #4 | A | 99.94% | 98.96% | [hi] | 99.81% | 99.68% | 99.92% | 99.98% | 99.97% | 100.0% |
| | C | 0.00% | 0.00% | 0.01% | 0.00% | 0.00% | 0.00% | 0.00% | 0.00% | 0.0% |
| | G | 0.05% | 1.04% | [hi] | 0.18% | 0.31% | 0.08% | 0.01% | 0.02% | 0.0% |
| | T | 0.00% | 0.00% | 0.00% | 0.00% | 0.00% | 0.00% | 0.00% | 0.00% | 0.0% |

| HEK2 pNMG-362 | | 2 A | 3 A | 5 A | 7 A | 8 A | 9 A | 12 A | 14 A | 16 A |
|---|---|---|---|---|---|---|---|---|---|---|
| Evo #4 | A | 99.96% | 99.13% | [hi] | 99.78% | 99.79% | 99.86% | 99.91% | 99.98% | 100.0% |
| | C | 0.00% | 0.00% | 0.00% | 0.00% | 0.00% | 0.00% | 0.00% | 0.00% | 0.0% |
| | G | 0.04% | 0.86% | [hi] | 0.21% | 0.20% | 0.14% | 0.08% | 0.01% | 0.0% |
| | T | 0.00% | 0.01% | 0.01% | 0.00% | 0.00% | 0.00% | 0.01% | 0.00% | 0.0% |

FIGURE 108 (Continued)

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-363 | | 2 A | 3 A | 5 A | 7 A | 8 A | 9 A | 12 A | 14 A | 16 A |
|---|---|---|---|---|---|---|---|---|---|---|
| Evo #4 | A | 99.92% | 98.69% | 72.23% | 99.68% | 99.71% | 99.92% | 99.95% | 99.97% | 100.0% |
|  | C | 0.00% | 0.00% | 0.01% | 0.00% | 0.00% | 0.00% | 0.00% | 0.00% | 0.0% |
|  | G | 0.07% | 1.30% | 27.75% | 0.32% | 0.28% | 0.07% | 0.04% | 0.02% | 0.0% |
|  | T | 0.01% | 0.00% | 0.01% | 0.00% | 0.01% | 0.00% | 0.00% | 0.00% | 0.0% |

| HEK2 pNMG-364 | | 2 A | 3 A | 5 A | 7 A | 8 A | 9 A | 12 A | 14 A | 16 A |
|---|---|---|---|---|---|---|---|---|---|---|
| Evo #4 | A | 99.97% | 99.01% | 85.96% | 99.68% | 99.78% | 99.90% | 99.95% | 99.97% | 100.0% |
|  | C | 0.00% | 0.00% | 0.00% | 0.00% | 0.00% | 0.00% | 0.00% | 0.00% | 0.0% |
|  | G | 0.03% | 0.98% | 14.00% | 0.32% | 0.21% | 0.10% | 0.04% | 0.02% | 0.0% |
|  | T | 0.00% | 0.00% | 0.02% | 0.00% | 0.01% | 0.01% | 0.01% | 0.00% | 0.0% |

| HEK2 pNMG-365 | | 2 A | 3 A | 5 A | 7 A | 8 A | 9 A | 12 A | 14 A | 16 A |
|---|---|---|---|---|---|---|---|---|---|---|
| Evo #4 | A | 99.97% | 99.08% | 72.04% | 99.81% | 99.78% | 99.90% | 99.95% | 99.98% | 100.0% |
|  | C | 0.00% | 0.00% | 0.00% | 0.00% | 0.00% | 0.00% | 0.00% | 0.00% | 0.0% |
|  | G | 0.03% | 0.91% | 27.94% | 0.18% | 0.21% | 0.10% | 0.04% | 0.01% | 0.0% |
|  | T | 0.00% | 0.00% | 0.01% | 0.00% | 0.01% | 0.00% | 0.01% | 0.00% | 0.0% |

| HEK2 pNMG-366 | | 2 A | 3 A | 5 A | 7 A | 8 A | 9 A | 12 A | 14 A | 16 A |
|---|---|---|---|---|---|---|---|---|---|---|
| Evo #4 | A | 99.90% | 98.23% | 71.19% | 99.58% | 99.73% | 99.85% | 99.93% | 99.97% | 100.0% |
|  | C | 0.00% | 0.00% | 0.00% | 0.00% | 0.00% | 0.00% | 0.00% | 0.00% | 0.0% |
|  | G | 0.10% | 1.76% | 28.80% | 0.41% | 0.26% | 0.15% | 0.06% | 0.02% | 0.0% |
|  | T | 0.00% | 0.00% | 0.01% | 0.00% | 0.00% | 0.00% | 0.01% | 0.00% | 0.0% |

| HEK2 pNMG-367 | | 2 A | 3 A | 5 A | 7 A | 8 A | 9 A | 12 A | 14 A | 16 A |
|---|---|---|---|---|---|---|---|---|---|---|
| Evo #4 | A | 99.92% | 98.73% | 66.94% | 99.68% | 99.78% | 99.90% | 99.95% | 99.97% | 100.0% |
|  | C | 0.00% | 0.00% | 0.01% | 0.00% | 0.00% | 0.00% | 0.00% | 0.00% | 0.0% |
|  | G | 0.08% | 1.26% | 33.04% | 0.32% | 0.21% | 0.10% | 0.04% | 0.02% | 0.0% |
|  | T | 0.00% | 0.01% | 0.01% | 0.00% | 0.01% | 0.01% | 0.01% | 0.00% | 0.0% |

| HEK2 pNMG-368 | | 2 A | 3 A | 5 A | 7 A | 8 A | 9 A | 12 A | 14 A | 16 A |
|---|---|---|---|---|---|---|---|---|---|---|
| Evo #4 | A | 99.97% | 99.72% | 99.32% | 99.95% | 99.92% | 99.96% | 99.97% | 99.98% | 100.0% |
|  | C | 0.00% | 0.00% | 0.00% | 0.00% | 0.00% | 0.00% | 0.00% | 0.00% | 0.0% |
|  | G | 0.02% | 0.27% | 0.67% | 0.05% | 0.08% | 0.03% | 0.02% | 0.01% | 0.0% |
|  | T | 0.00% | 0.00% | 0.01% | 0.00% | 0.00% | 0.00% | 0.01% | 0.00% | 0.0% |

FIGURE 109

HEK2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-369 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.73% | 99.58% | 93.68% | 99.55% | 99.15% | 99.93% | 99.96% | 99.98% | 100.00% |
| | C | 0.01% | 0.00% | 0.01% | 0.01% | 0.00% | 0.00% | 0.01% | 0.00% | 0.00% |
| | G | 0.25% | 0.41% | 6.30% | 0.44% | 0.85% | 0.07% | 0.02% | 0.01% | 0.00% |
| | T | 0.01% | 0.01% | 0.00% | 0.00% | 0.00% | 0.00% | 0.01% | 0.00% | 0.00% |

| HEK2-3 pNMG-370 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.93% | 99.89% | 94.96% | 99.92% | 99.74% | 99.98% | 99.99% | 99.99% | 99.99% |
| | C | 0.01% | 0.00% | 0.01% | 0.01% | 0.00% | 0.00% | 0.00% | 0.00% | 0.00% |
| | G | 0.06% | 0.11% | 5.03% | 0.07% | 0.25% | 0.02% | 0.00% | 0.01% | 0.00% |
| | T | 0.01% | 0.00% | 0.00% | 0.00% | 0.01% | 0.00% | 0.00% | 0.00% | 0.01% |

| HEK2-3 pNMG-371 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.69% | 99.59% | 93.56% | 99.75% | 99.46% | 99.94% | 99.96% | 99.98% | 99.98% |
| | C | 0.01% | 0.01% | 0.01% | 0.02% | 0.02% | 0.01% | 0.02% | 0.01% | 0.01% |
| | G | 0.30% | 0.40% | 6.45% | 0.23% | 0.52% | 0.05% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-360 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.82% | 99.88% | 98.75% | 99.90% | 99.92% | 99.98% | 99.98% | 99.99% | 99.99% |
| | C | 0.00% | 0.00% | 0.01% | 0.02% | 0.02% | 0.01% | 0.00% | 0.00% | 0.00% |
| | G | 0.18% | 0.10% | 1.25% | 0.08% | 0.06% | 0.01% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-361 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.98% | 99.56% | 99.97% | 99.98% | 99.99% | 99.99% | 99.99% | 99.99% |
| | C | 0.00% | 0.00% | 0.01% | 0.01% | 0.00% | 0.00% | 0.00% | 0.00% | 0.00% |
| | G | 0.03% | 0.02% | 0.44% | 0.02% | 0.01% | 0.00% | 0.01% | 0.00% | 0.01% |
| | T | 0.00% | 0.00% | 0.00% | 0.00% | 0.00% | 0.00% | 0.01% | 0.01% | 0.00% |

| HEK2-3 pNMG-362 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.91% | 99.94% | 98.06% | 99.93% | 99.89% | 99.96% | 99.98% | 99.98% | 99.99% |
| | C | 0.01% | 0.00% | 0.00% | 0.01% | 0.00% | 0.00% | 0.00% | 0.00% | 0.00% |
| | G | 0.09% | 0.06% | 1.93% | 0.06% | 0.10% | 0.04% | 0.02% | 0.02% | 0.00% |
| | T | 0.00% | 0.00% | 0.00% | 0.00% | 0.00% | 0.00% | 0.00% | 0.00% | 0.01% |

FIGURE 109 (Continued)

HEK2-3 site: 5'-GTA₃A₄A₅CA₇A₈A₉GCA₁₂TA₁₄GA₁₆CTGAGGG-3'

| HEK2-3 pNMG-363 | | 3 A | 4 A | 5 A | 7 A | 8 A | 9 A | 12 A | 14 A | 16 A |
|---|---|---|---|---|---|---|---|---|---|---|
| | A | 99.80% | 99.91% | 97.59% | 99.90% | 99.98% | 99.97% | 99.96% | 99.99% | 99.99% |
| | C | 0.00% | 0.00% | 0.01% | 0.00% | 0.01% | 0.00% | 0.01% | 0.00% | 0.00% |
| | G | 0.19% | 0.09% | 2.40% | 0.09% | 0.10% | 0.03% | 0.02% | 0.01% | 0.00% |
| | T | 0.00% | 0.00% | 0.00% | 0.00% | 0.01% | 0.00% | 0.02% | 0.00% | 0.00% |

| HEK2-3 pNMG-364 | | 3 A | 4 A | 5 A | 7 A | 8 A | 9 A | 12 A | 14 A | 16 A |
|---|---|---|---|---|---|---|---|---|---|---|
| | A | 99.96% | 99.97% | 99.47% | 99.95% | 99.98% | 100.00% | 99.99% | 99.98% | 100.00% |
| | C | 0.01% | 0.00% | 0.01% | 0.01% | 0.00% | 0.00% | 0.00% | 0.00% | 0.00% |
| | G | 0.03% | 0.02% | 0.51% | 0.04% | 0.01% | 0.00% | 0.00% | 0.01% | 0.00% |
| | T | 0.01% | 0.00% | 0.01% | 0.00% | 0.00% | 0.00% | 0.00% | 0.01% | 0.00% |

| HEK2-3 pNMG-365 | | 3 A | 4 A | 5 A | 7 A | 8 A | 9 A | 12 A | 14 A | 16 A |
|---|---|---|---|---|---|---|---|---|---|---|
| | A | 99.91% | 99.97% | 98.48% | 99.95% | 99.92% | 99.97% | 99.92% | 99.98% | 100.00% |
| | C | 0.00% | 0.00% | 0.00% | 0.01% | 0.01% | 0.00% | 0.00% | 0.00% | 0.00% |
| | G | 0.09% | 0.02% | 1.51% | 0.04% | 0.07% | 0.02% | 0.07% | 0.01% | 0.00% |
| | T | 0.00% | 0.00% | 0.00% | 0.00% | 0.00% | 0.00% | 0.01% | 0.00% | 0.00% |

| HEK2-3 pNMG-366 | | 3 A | 4 A | 5 A | 7 A | 8 A | 9 A | 12 A | 14 A | 16 A |
|---|---|---|---|---|---|---|---|---|---|---|
| | A | 99.70% | 99.86% | 97.73% | 99.68% | 99.77% | 99.97% | 99.98% | 99.99% | 99.99% |
| | C | 0.00% | 0.00% | 0.00% | 0.01% | 0.01% | 0.01% | 0.00% | 0.00% | 0.00% |
| | G | 0.29% | 0.14% | 2.27% | 0.30% | 0.22% | 0.02% | 0.02% | 0.00% | 0.00% |
| | T | 0.00% | 0.00% | 0.00% | 0.00% | 0.00% | 0.00% | 0.00% | 0.00% | 0.01% |

| HEK2-3 pNMG-367 | | 3 A | 4 A | 5 A | 7 A | 8 A | 9 A | 12 A | 14 A | 16 A |
|---|---|---|---|---|---|---|---|---|---|---|
| | A | 99.87% | 99.90% | 97.80% | 99.87% | 99.91% | 99.97% | 99.92% | 99.96% | 99.99% |
| | C | 0.00% | 0.00% | 0.00% | 0.01% | 0.01% | 0.00% | 0.01% | 0.00% | 0.00% |
| | G | 0.12% | 0.10% | 2.19% | 0.11% | 0.08% | 0.02% | 0.05% | 0.02% | 0.01% |
| | T | 0.01% | 0.00% | 0.00% | 0.00% | 0.00% | 0.00% | 0.01% | 0.01% | 0.00% |

| HEK2-3 pNMG-368 | | 3 A | 4 A | 5 A | 7 A | 8 A | 9 A | 12 A | 14 A | 16 A |
|---|---|---|---|---|---|---|---|---|---|---|
| | A | 99.97% | 100.00% | 100.00% | 99.99% | 99.98% | 100.00% | 99.98% | 99.98% | 100.00% |
| | C | 0.00% | 0.00% | 0.00% | 0.01% | 0.01% | 0.00% | 0.00% | 0.01% | 0.00% |
| | G | 0.02% | 0.00% | 0.00% | 0.00% | 0.00% | 0.00% | 0.01% | 0.01% | 0.00% |
| | T | 0.00% | 0.00% | 0.00% | 0.01% | 0.01% | 0.00% | 0.01% | 0.00% | 0.00% |

FIGURE 110

HEK2-6: 5'-GA$_2$A$_3$GA$_5$CCA$_8$A$_9$GGA$_{12}$TA$_{14}$GACTGCTGG-3'

| HEK2-6 pNMG-369 | | 2 A | 3 A | 5 A | 8 A | 9 A | 12 A | 14 A |
|---|---|---|---|---|---|---|---|---|
| | A | 99.80% | 99.94% | 95.07% | 99.70% | 99.74% | 99.94% | 99.94% |
| | C | 0.07% | 0.06% | 0.00% | 0.00% | 0.00% | 0.00% | 0.00% |
| | G | 0.13% | 0.00% | 4.87% | 0.30% | 0.26% | 0.06% | 0.06% |
| | T | 0.00% | 0.00% | 0.06% | 0.00% | 0.00% | 0.00% | 0.00% |

| HEK2-6 pNMG-370 | | 2 A | 3 A | 5 A | 8 A | 9 A | 12 A | 14 A |
|---|---|---|---|---|---|---|---|---|
| | A | 99.97% | 99.98% | 96.45% | 99.77% | 99.92% | 99.98% | 99.98% |
| | C | 0.03% | 0.02% | 0.00% | 0.00% | 0.03% | 0.00% | 0.00% |
| | G | 0.00% | 0.00% | 3.50% | 0.23% | 0.03% | 0.02% | 0.02% |
| | T | 0.00% | 0.00% | 0.05% | 0.00% | 0.03% | 0.00% | 0.00% |

| HEK2-6 pNMG-371 | | 2 A | 3 A | 5 A | 8 A | 9 A | 12 A | 14 A |
|---|---|---|---|---|---|---|---|---|
| | A | 99.97% | 99.94% | 96.33% | 99.80% | 99.78% | 100.00% | 100.00% |
| | C | 0.00% | 0.03% | 0.00% | 0.00% | 0.00% | 0.00% | 0.00% |
| | G | 0.03% | 0.00% | 3.67% | 0.20% | 0.19% | 0.00% | 0.00% |
| | T | 0.00% | 0.03% | 0.00% | 0.00% | 0.03% | 0.00% | 0.00% |

| HEK2-6 pNMG-360 | | 2 A | 3 A | 5 A | 8 A | 9 A | 12 A | 14 A |
|---|---|---|---|---|---|---|---|---|
| | A | 100.00% | 99.96% | 99.03% | 99.96% | 99.91% | 99.96% | 100.00% |
| | C | 0.00% | 0.04% | 0.00% | 0.00% | 0.09% | 0.00% | 0.00% |
| | G | 0.00% | 0.00% | 0.97% | 0.04% | 0.00% | 0.04% | 0.00% |
| | T | 0.00% | 0.00% | 0.00% | 0.00% | 0.00% | 0.00% | 0.00% |

| HEK2-6 361 | | 2 A | 3 A | 5 A | 8 A | 9 A | 12 A | 14 A |
|---|---|---|---|---|---|---|---|---|
| | A | 99.97% | 99.97% | 99.67% | 100.00% | 99.97% | 99.97% | 100.00% |
| | C | 0.00% | 0.00% | 0.00% | 0.00% | 0.00% | 0.00% | 0.00% |
| | G | 0.03% | 0.03% | 0.30% | 0.00% | 0.00% | 0.03% | 0.00% |
| | T | 0.00% | 0.00% | 0.03% | 0.00% | 0.03% | 0.00% | 0.00% |

| HEK2-6 362 | | 2 A | 3 A | 5 A | 8 A | 9 A | 12 A | 14 A |
|---|---|---|---|---|---|---|---|---|
| | A | 99.96% | 99.92% | 98.65% | 99.94% | 99.98% | 99.94% | 99.98% |
| | C | 0.02% | 0.08% | 0.00% | 0.00% | 0.00% | 0.00% | 0.00% |
| | G | 0.02% | 0.00% | 1.35% | 0.04% | 0.02% | 0.04% | 0.02% |
| | T | 0.00% | 0.00% | 0.00% | 0.02% | 0.00% | 0.02% | 0.00% |

FIGURE 110 (Continued)

HEK2-6: 5'-GA$_2$A$_3$GA$_5$CCA$_8$A$_9$GGA$_{12}$TA$_{14}$GACTGCTGG-3'

| HEK2-6 363 | | 2 A | 3 A | 5 A | 8 A | 9 A | 12 A | 14 A |
|---|---|---|---|---|---|---|---|---|
| | A | 99.97% | 99.97% | 95.64% | 99.93% | 99.99% | 99.99% | 99.99% |
| | C | 0.00% | 0.00% | 0.00% | 0.00% | 0.00% | 0.00% | 0.00% |
| | G | 0.03% | 0.03% | 4.36% | 0.05% | 0.01% | 0.00% | 0.00% |
| | T | 0.00% | 0.00% | 0.00% | 0.01% | 0.00% | 0.01% | 0.01% |

| HEK2-6 364 | | 2 A | 3 A | 5 A | 8 A | 9 A | 12 A | 14 A |
|---|---|---|---|---|---|---|---|---|
| | A | 99.98% | 99.98% | 99.59% | 99.98% | 99.90% | 99.98% | 100.00% |
| | C | 0.00% | 0.00% | 0.00% | 0.00% | 0.02% | 0.00% | 0.00% |
| | G | 0.00% | 0.02% | 0.39% | 0.02% | 0.06% | 0.02% | 0.00% |
| | T | 0.02% | 0.00% | 0.02% | 0.00% | 0.02% | 0.00% | 0.00% |

| HEK2-6 365 | | 2 A | 3 A | 5 A | 8 A | 9 A | 12 A | 14 A |
|---|---|---|---|---|---|---|---|---|
| | A | 99.95% | 100.00% | 97.12% | 99.95% | 99.82% | 99.85% | 100.00% |
| | C | 0.00% | 0.00% | 0.00% | 0.00% | 0.00% | 0.03% | 0.00% |
| | G | 0.03% | 0.00% | 2.86% | 0.02% | 0.18% | 0.10% | 0.00% |
| | T | 0.03% | 0.00% | 0.02% | 0.02% | 0.00% | 0.03% | 0.00% |

| HEK2-6 366 | | 2 A | 3 A | 5 A | 8 A | 9 A | 12 A | 14 A |
|---|---|---|---|---|---|---|---|---|
| | A | 99.90% | 99.96% | 97.54% | 99.82% | 99.98% | 99.88% | 99.98% |
| | C | 0.04% | 0.00% | 0.00% | 0.00% | 0.02% | 0.00% | 0.00% |
| | G | 0.02% | 0.04% | 2.46% | 0.15% | 0.00% | 0.08% | 0.02% |
| | T | 0.04% | 0.00% | 0.00% | 0.04% | 0.00% | 0.04% | 0.00% |

| HEK2-6 367 | | 2 A | 3 A | 5 A | 8 A | 9 A | 12 A | 14 A |
|---|---|---|---|---|---|---|---|---|
| | A | 99.89% | 99.99% | 97.00% | 99.93% | 99.94% | 99.96% | 99.99% |
| | C | 0.03% | 0.00% | 0.01% | 0.01% | 0.01% | 0.01% | 0.00% |
| | G | 0.06% | 0.01% | 2.97% | 0.04% | 0.03% | 0.00% | 0.00% |
| | T | 0.02% | 0.00% | 0.01% | 0.01% | 0.01% | 0.03% | 0.01% |

| HEK2-6 368 | | 2 A | 3 A | 5 A | 8 A | 9 A | 12 A | 14 A |
|---|---|---|---|---|---|---|---|---|
| | A | 99.92% | 99.96% | 99.96% | 99.99% | 99.99% | 99.98% | 100.00% |
| | C | 0.02% | 0.02% | 0.00% | 0.00% | 0.01% | 0.00% | 0.00% |
| | G | 0.04% | 0.02% | 0.01% | 0.01% | 0.00% | 0.01% | 0.00% |
| | T | 0.02% | 0.00% | 0.03% | 0.00% | 0.00% | 0.01% | 0.00% |

FIGURE 111

HEK2-7: 3'-CCTGCAGT CAAT GAT T T GT T T T G-5'
                        16   12    9 8 7  5 4 3 2

| HEK2-7 pNMG-369 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.01% | 0.00% | 0.01% | 0.00% | 0.00% | 0.00% | 0.00% | 0.00% |
| | C | 0.01% | 0.01% | 0.08% | 0.09% | 0.05% | 0.83% | 0.06% | 0.03% | 0.02% |
| | G | 0.00% | 0.00% | 0.00% | 0.00% | 0.00% | 0.00% | 0.00% | 0.00% | 0.00% |
| | T | 99.98% | 99.98% | 99.91% | 99.91% | 99.95% | 99.16% | 99.93% | 99.96% | 99.98% |

| HEK2-7 pNMG-370 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.01% | 0.00% | 0.01% | 0.00% | 0.00% | 0.01% | 0.01% | 0.01% |
| | C | 0.00% | 0.00% | 0.01% | 0.00% | 0.01% | 0.24% | 0.01% | 0.01% | 0.01% |
| | G | 0.01% | 0.00% | 0.00% | 0.00% | 0.01% | 0.01% | 0.01% | 0.00% | 0.00% |
| | T | 99.99% | 99.99% | 99.99% | 99.99% | 99.98% | 99.75% | 99.96% | 99.98% | 99.97% |

| HEK2-7 pNMG-371 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.00% | 0.00% | 0.01% | 0.00% | 0.00% | 0.00% |
| | C | 0.00% | 0.01% | 0.06% | 0.04% | 0.10% | 0.35% | 0.02% | 0.01% | 0.00% |
| | G | 0.00% | 0.00% | 0.00% | 0.00% | 0.00% | 0.00% | 0.00% | 0.00% | 0.03% |
| | T | 100.00% | 99.99% | 99.94% | 99.96% | 99.90% | 99.63% | 99.98% | 99.99% | 99.97% |

| HEK2-7 pNMG-360 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.01% | 0.01% | 0.01% | 0.00% | 0.00% | 0.01% |
| | C | 0.01% | 0.00% | 0.01% | 0.03% | 0.00% | 0.09% | 0.03% | 0.02% | 0.02% |
| | G | 0.00% | 0.00% | 0.01% | 0.00% | 0.00% | 0.00% | 0.00% | 0.00% | 0.01% |
| | T | 99.99% | 100.00% | 99.98% | 99.95% | 99.99% | 99.89% | 99.97% | 99.98% | 99.95% |

| HEK2-7 pNMG-361 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.02% | 0.02% | 0.00% | 0.00% | 0.00% | 0.00% | 0.00% | 0.00% | 0.00% |
| | C | 0.02% | 0.04% | 0.00% | 0.00% | 0.02% | 0.06% | 0.02% | 0.00% | 0.02% |
| | G | 0.00% | 0.00% | 0.00% | 0.00% | 0.00% | 0.00% | 0.00% | 0.00% | 0.00% |
| | T | 99.96% | 99.94% | 100.00% | 100.00% | 99.98% | 99.94% | 99.98% | 100.00% | 99.98% |

| HEK2-7 pNMG-362 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.02% | 0.00% | 0.00% | 0.00% | 0.00% | 0.00% | 0.00% | 0.00% | 0.02% |
| | C | 0.00% | 0.00% | 0.00% | 0.05% | 0.00% | 0.10% | 0.00% | 0.05% | 0.02% |
| | G | 0.00% | 0.00% | 0.00% | 0.00% | 0.00% | 0.00% | 0.00% | 0.00% | 0.00% |
| | T | 99.98% | 100.00% | 100.00% | 99.95% | 100.00% | 99.90% | 100.00% | 99.95% | 99.95% |

FIGURE 111 (Continued)

HEK2-7: 3'-CCTGCAGT CAAT GAT T T GT T T T G-5'
                   16   12    9 8 7   5 4 3 2

| HEK2-7 pNMG-363 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.03% | 0.00% | 0.00% | 0.00% | 0.00% | 0.00% |
| | C | 0.00% | 0.03% | 0.00% | 0.00% | 0.00% | 0.16% | 0.00% | 0.00% | 0.00% |
| | G | 0.00% | 0.00% | 0.00% | 0.00% | 0.00% | 0.00% | 0.00% | 0.00% | 0.00% |
| | T | 100.00% | 99.97% | 100.00% | 99.97% | 100.00% | 99.98% | 100.00% | 100.00% | 100.00% |

| HEK2-7 pNMG-364 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.02% | 0.00% | 0.00% | 0.00% | 0.00% | 0.00% |
| | C | 0.02% | 0.02% | 0.00% | 0.00% | 0.00% | 0.02% | 0.02% | 0.02% | 0.04% |
| | G | 0.00% | 0.00% | 0.00% | 0.00% | 0.00% | 0.00% | 0.00% | 0.00% | 0.00% |
| | T | 99.98% | 99.98% | 100.00% | 99.98% | 100.00% | 99.98% | 99.98% | 99.98% | 99.96% |

| HEK2-7 pNMG-365 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.00% | 0.00% | 0.00% | 0.00% | 0.00% | 0.00% | 0.00% | 0.01% |
| | C | 0.01% | 0.01% | 0.04% | 0.01% | 0.01% | 0.07% | 0.01% | 0.01% | 0.00% |
| | G | 0.00% | 0.00% | 0.00% | 0.00% | 0.00% | 0.00% | 0.00% | 0.00% | 0.01% |
| | T | 99.98% | 99.99% | 99.96% | 99.99% | 99.99% | 99.93% | 99.99% | 99.99% | 99.97% |

| HEK2-7 pNMG-366 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.01% | 0.01% | 0.00% | 0.01% | 0.00% | 0.00% | 0.01% | 0.00% |
| | C | 0.02% | 0.02% | 0.02% | 0.04% | 0.03% | 0.07% | 0.00% | 0.02% | 0.01% |
| | G | 0.00% | 0.00% | 0.00% | 0.01% | 0.00% | 0.01% | 0.00% | 0.00% | 0.00% |
| | T | 99.98% | 99.98% | 99.97% | 99.95% | 99.97% | 99.92% | 100.00% | 99.98% | 99.99% |

| HEK2-7 pNMG-367 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.01% | 0.00% | 0.00% | 0.00% | 0.00% | 0.00% | 0.00% | 0.00% |
| | C | 0.01% | 0.03% | 0.01% | 0.01% | 0.00% | 0.07% | 0.01% | 0.02% | 0.00% |
| | G | 0.00% | 0.00% | 0.00% | 0.00% | 0.00% | 0.01% | 0.00% | 0.00% | 0.00% |
| | T | 99.99% | 99.96% | 99.99% | 99.99% | 100.00% | 99.92% | 99.99% | 99.98% | 99.99% |

| HEK2-7 pNMG-368 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.00% | 0.00% | 0.01% | 0.01% | 0.00% | 0.00% | 0.00% | 0.01% |
| | C | 0.00% | 0.00% | 0.00% | 0.01% | 0.01% | 0.00% | 0.00% | 0.02% | 0.01% |
| | G | 0.00% | 0.00% | 0.00% | 0.01% | 0.00% | 0.02% | 0.00% | 0.00% | 0.00% |
| | T | 99.99% | 100.00% | 99.99% | 99.97% | 99.98% | 99.97% | 100.00% | 99.97% | 99.98% |

FIGURE 112

HEK2-10: 3'-CCATCAT T C T AT T CT T T AT GT T C-5'
               17 16  14 12  11  9 8 7  5 3  2

| HEK2-10 pNMG-369 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.03% | 0.04% | 0.00% | 0.00% | 0.00% | 0.00% | 0.00% | 0.00% | 0.01% | 0.01% | 0.00% |
| | C | 0.02% | 0.01% | 0.01% | 0.14% | 0.38% | 0.31% | 0.88% | 1.20% | 7.43% | 1.02% | 0.27% |
| | G | 0.01% | 0.00% | 0.00% | 0.00% | 0.01% | 0.00% | 0.00% | 0.01% | 0.00% | 0.00% | 0.00% |
| | T | | | | | | | | | | | |

| HEK2-10 pNMG-370 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.03% | 0.05% | 0.00% | 0.01% | 0.01% | 0.01% | 0.00% | 0.00% | 0.01% | 0.00% | 0.01% |
| | C | 0.03% | 0.01% | 0.02% | 0.29% | 0.10% | 0.08% | 0.60% | 0.43% | 3.53% | 0.30% | 0.30% |
| | G | 0.00% | 0.00% | 0.00% | 0.00% | 0.00% | 0.00% | 0.01% | 0.00% | 0.00% | 0.00% | 0.00% |
| | T | | | | | | | | | | | |

| HEK2-10 pNMG-371 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.10% | 0.01% | 0.03% | 0.00% | 0.00% | 0.00% | 0.01% | 0.01% | 0.00% | 0.00% |
| | C | 0.01% | 0.01% | 0.01% | 0.47% | 0.20% | 0.30% | 1.12% | 1.35% | 7.27% | 0.70% | 0.54% |
| | G | 0.00% | 0.00% | 0.00% | 0.00% | 0.01% | 0.00% | 0.00% | 0.00% | 0.00% | 0.00% | 0.00% |
| | T | | | | | | | | | | | |

| HEK2-10 pNMG-360 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.09% | 0.00% | 0.00% | 0.00% | 0.01% | 0.00% | 0.01% | 0.00% | 0.01% | 0.00% |
| | C | 0.01% | 0.01% | 0.03% | 0.60% | 0.24% | 0.03% | 0.66% | 0.14% | 1.20% | 0.17% | 0.02% |
| | G | 0.01% | 0.00% | 0.00% | 0.00% | 0.02% | 0.00% | 0.02% | 0.01% | 0.00% | 0.00% | 0.00% |
| | T | | | | | | | | | | | |

| HEK2-10 pNMG-361 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.16% | 0.00% | 0.00% | 0.04% | 0.03% | 0.00% | 0.01% | 0.01% | 0.01% | 0.01% |
| | C | 0.03% | 0.00% | 0.06% | 0.52% | 0.12% | 0.03% | 0.58% | 0.11% | 0.21% | 0.04% | 0.42% |
| | G | 0.01% | 0.00% | 0.00% | 0.00% | 0.02% | 0.00% | 0.02% | 0.03% | 0.00% | 0.00% | 0.00% |
| | T | | | | | | | | | | | |

| HEK2-10 pNMG-362 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.07% | 0.01% | 0.00% | 0.00% | 0.00% | 0.01% | 0.00% | 0.00% | 0.01% | 0.01% |
| | C | 0.03% | 0.01% | 0.01% | 0.40% | 1.06% | 0.13% | 0.40% | 0.16% | 1.37% | 0.17% | 0.28% |
| | G | 0.03% | 0.00% | 0.00% | 0.00% | 0.01% | 0.00% | 0.00% | 0.00% | 0.00% | 0.00% | 0.00% |
| | T | | | | | | | | | | | |

FIGURE 112 (Continued)

HEK2-10: 3'-CCATCAT T C T AT T CT T T AT GT T C-5'
                    17 16  14  12 11  9 8  7  5 3 2

| HEK2-10 pNMG-363 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.02% | 0.00% | 0.01% | 0.01% | 0.00% | 0.00% | 0.03% | 0.03% | 0.00% | 0.01% |
| | C | 0.02% | 0.01% | 0.01% | 0.15% | 1.24% | 0.13% | 0.30% | 0.35% | 3.03% | 0.41% | 0.23% |
| | G | 0.01% | 0.00% | 0.07% | 0.00% | 0.03% | 0.00% | 0.00% | 0.00% | 0.00% | 0.00% | 0.00% |
| | T | | | | | | | | | | | |

| HEK2-10 pNMG-364 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.07% | 0.01% | 0.00% | 0.00% | 0.00% | 0.01% | 0.00% | 0.00% | 0.00% | 0.00% |
| | C | 0.02% | 0.01% | 0.01% | 0.38% | 0.04% | 0.01% | 0.39% | 0.04% | 0.49% | 0.14% | 0.36% |
| | G | 0.01% | 0.00% | 0.07% | 0.00% | 0.03% | 0.00% | 0.00% | 0.00% | 0.00% | 0.00% | 0.00% |
| | T | | | | | | | | | | | |

| HEK2-10 pNMG-365 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.12% | 0.00% | 0.00% | 0.00% | 0.00% | 0.00% | 0.00% | 0.01% | 0.01% | 0.03% |
| | C | 0.01% | 0.01% | 0.02% | 0.40% | 1.68% | 0.06% | 0.48% | 0.13% | 1.51% | 0.24% | 0.40% |
| | G | 0.00% | 0.00% | 0.00% | 0.00% | 0.00% | 0.00% | 0.01% | 0.00% | 0.00% | 0.00% | 0.00% |
| | T | | | | | | | | | | | |

| HEK2-10 pNMG-366 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.02% | 0.01% | 0.01% | 0.00% | 0.00% | 0.01% | 0.00% | 0.00% | 0.01% | 0.00% |
| | C | 0.01% | 0.01% | 0.01% | 0.08% | 0.28% | 0.15% | 0.35% | 0.66% | 2.82% | 0.61% | 0.33% |
| | G | 0.00% | 0.00% | 0.00% | 0.00% | 0.00% | 0.00% | 0.00% | 0.00% | 0.00% | 0.00% | 0.00% |
| | T | | | | | | | | | | | |

| HEK2-10 pNMG-367 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.07% | 0.03% | 0.01% | 0.00% | 0.00% | 0.00% | 0.00% | 0.00% | 0.03% | 0.01% |
| | C | 0.01% | 0.01% | 0.01% | 0.38% | 0.84% | 0.11% | 0.52% | 0.26% | 2.27% | 0.27% | 0.51% |
| | G | 0.00% | 0.00% | 0.07% | 0.07% | 0.03% | 0.00% | 0.00% | 0.00% | 0.00% | 0.07% | 0.00% |
| | T | | | | | | | | | | | |

| HEK2-10 pNMG-368 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.05% | 0.01% | 0.00% | 0.03% | 0.00% | 0.00% | 0.00% | 0.01% | 0.00% | 0.03% |
| | C | 0.02% | 0.01% | 0.03% | 0.12% | 0.01% | 0.01% | 0.21% | 0.03% | 0.02% | 0.03% | 0.19% |
| | G | 0.01% | 0.00% | 0.00% | 0.00% | 0.01% | 0.00% | 0.00% | 0.03% | 0.00% | 0.00% | 0.00% |
| | T | | | | | | | | | | | |

FIGURE 113

Hek3- 5'-GGCCCA GA CTGA GCA CGTGATGG-3'

Hek-2 site: 3'-CCCGCAGT$_{16}$CT$_{14}$AT$_{12}$GCT$_9$T$_8$T$_7$G T$_5$GT$_3$T$_2$C-5'

| HEK2 pNMG-370/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.00% | 0.01% | 0.00% | 0.04% | 0.01% | 0.00% |
| | C | 0.01% | 0.03% | 0.01% | 0.34% | 0.67% | 0.44% | | 1.20% | 0.10% |
| | G | 0.00% | 0.00% | 0.00% | 0.00% | 0.00% | 0.00% | 0.03% | 0.00% | 0.00% |
| | T | 99.98% | 99.96% | 99.97% | 99.65% | 99.32% | 99.56% | | 98.79% | 99.89% |

| HEK2 pNMG-371/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.01% | 0.00% |
| | C | 0.01% | 0.02% | 0.05% | 0.73% | 1.26% | 1.46% | | 3.91% | 0.11% |
| | G | 0.01% | 0.00% | 0.00% | 0.00% | 0.01% | 0.00% | 0.01% | 0.00% | 0.00% |
| | T | 99.98% | 99.97% | 99.94% | 99.26% | 98.73% | 98.55% | | 96.07% | 99.89% |

| HEK2 pNMG-382/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | | 0.55% | 0.06% |
| | G | 0.01% | 0.00% | 0.00% | 0.00% | 0.00% | 0.00% | 0.02% | 0.00% | 0.00% |
| | T | 99.97% | 99.98% | 99.97% | 99.98% | 99.76% | 99.69% | | 99.45% | 99.93% |

| HEK2 pNMG-383/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | | 0.29% | 0.05% |
| | G | 0.01% | 0.00% | 0.00% | 0.00% | 0.01% | 0.00% | 0.01% | 0.00% | 0.00% |
| | T | 99.97% | 99.98% | 99.97% | 99.90% | 99.91% | 99.87% | | 99.69% | 99.94% |

| HEK2 pNMG-384/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.88% | | 99.86% | 99.97% |

| HEK2 pNMG-385/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | | 0.12% | 0.05% |
| | G | 0.01% | 0.00% | 0.00% | 0.00% | 0.01% | 0.00% | 0.01% | 0.00% | 0.00% |
| | T | 99.99% | 99.98% | 99.98% | 99.99% | 99.92% | 99.91% | | 99.86% | 99.95% |

| HEK2 pNMG-386/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | | 0.80% | 0.04% |
| | G | 0.01% | 0.00% | 0.00% | 0.00% | 0.01% | 0.00% | 0.01% | 0.00% | 0.00% |
| | T | 99.97% | 99.98% | 99.98% | 99.93% | 99.54% | 99.87% | | 99.20% | 99.96% |

FIGURE 115 (Continued)

Hek-2 site: 3'-CCCGCAGT₁₆CT₁₄AT₁₂GCT₉T₈T₇GT₅GT₃T₂C-5'

| HEK2 pNMG-387/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | | 0.63% | 0.02% |
| | G | 0.00% | 0.00% | 0.00% | 0.00% | 0.01% | 0.00% | 0.01% | 0.00% | 0.00% |
| | T | 99.98% | 99.97% | 99.97% | 99.94% | 99.79% | 99.86% | | 99.37% | 99.98% |

| HEK2 pNMG-388/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | | 0.55% | 0.07% |
| | G | 0.00% | 0.00% | 0.00% | 0.00% | 0.01% | 0.00% | 0.01% | 0.00% | 0.00% |
| | T | 99.99% | 99.97% | 99.98% | 99.95% | 99.81% | 99.87% | | 99.44% | 99.93% |

| HEK2 pNMG-389/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | | 0.40% | 0.07% |
| | G | 0.00% | 0.00% | 0.00% | 0.00% | 0.00% | 0.01% | 0.01% | 0.00% | 0.00% |
| | T | 99.98% | 99.99% | 99.99% | 99.89% | 99.79% | 99.77% | | 99.60% | 99.92% |

| HEK2 pNMG-370/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.01% | 0.03% | 0.01% | 0.01% |
| | C | 0.01% | 0.02% | 0.01% | 0.90% | 10.58% | 1.26% | | | 0.73% |
| | G | 0.01% | 0.00% | 0.00% | 0.00% | 0.05% | 0.00% | 0.00% | 0.00% | 0.00% |
| | T | 99.98% | 99.97% | 99.98% | 99.09% | | 98.73% | | | 99.26% |

| HEK2 pNMG-371/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.05% | 0.02% | 0.02% | 0.03% | 0.00% |
| | C | 0.01% | 0.02% | 0.04% | 1.52% | | 4.44% | | | 1.66% |
| | G | 0.01% | 0.00% | 0.00% | 0.00% | 0.03% | 0.00% | 0.03% | 0.00% | 0.00% |
| | T | 99.98% | 99.98% | 99.95% | 98.48% | | 95.54% | | | 98.33% |

| HEK2 pNMG-382/301 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.00% | 0.00% | 0.00% |
| | C | 0.01% | 0.01% | 0.02% | 0.13% | 6.00% | 0.73% | | 12.15% | 0.80% |
| | G | 0.01% | 0.00% | 0.00% | 0.00% | 0.05% | 0.00% | 0.00% | 0.03% | 0.00% |
| | T | 99.98% | 99.98% | 99.97% | 99.87% | 93.94% | 99.27% | | 87.82% | 99.20% |

| HEK2 pNMG-383/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.01% | 0.01% | 0.01% | 0.00% |
| | C | 0.01% | 0.02% | 0.01% | 0.51% | 3.02% | 0.62% | | | 0.30% |
| | G | 0.00% | 0.00% | 0.00% | 0.00% | 0.01% | 0.00% | 0.00% | 0.00% | 0.00% |
| | T | 99.99% | 99.98% | 99.98% | 99.49% | 96.97% | 99.37% | | 99.34% | 99.69% |

FIGURE 115 (Continued)

Hek-2 site: 3'-CCCGCAGT$_{16}$CT$_{14}$AT$_{12}$GCT$_9$T$_8$T$_7$G T$_5$GT$_3$T$_2$C-5'

| HEK2 pNMG-384/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.01% | 0.00% | 0.00% | 0.01% | 0.00% | 0.00% |
| | C | 0.01% | 0.02% | 0.01% | 0.42% | 2.72% | 0.18% | 13.40% | 6.88% | 0.12% |
| | G | 0.01% | 0.00% | 0.00% | 0.00% | 0.03% | 0.00% | 0.00% | 0.00% | 0.00% |
| | T | 99.98% | 99.98% | 99.97% | 99.56% | 97.25% | 99.82% | 86.58% | 93.11% | 99.87% |

| HEK2 pNMG-385/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.00% | 0.00% | 0.01% |
| | C | 0.00% | 0.02% | 0.01% | 0.06% | 0.43% | 0.06% | 8.73% | 2.84% | 0.11% |
| | G | 0.01% | 0.00% | 0.00% | 0.00% | 0.01% | 0.00% | 0.00% | 0.00% | 0.00% |
| | T | 99.99% | 99.98% | 99.98% | 99.93% | 99.56% | 99.94% | 91.27% | 97.16% | 99.88% |

| HEK2 pNMG-386/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.64% | 2.94% | 0.28% | 15.03% | 7.73% | 0.23% |
| | G | 0.05% | 0.00% | 0.00% | 0.00% | 0.01% | 0.00% | 0.00% | 0.01% | 0.00% |
| | T | 99.94% | 99.98% | 99.98% | 99.35% | 97.04% | 99.72% | 84.96% | 92.26% | 99.76% |

| HEK2 pNMG-387/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.01% | 0.04% | 0.13% | 3.90% | 0.44% | 15.03% | 10.22% | 0.57% |
| | G | 0.00% | 0.00% | 0.00% | 0.00% | 0.01% | 0.00% | 0.01% | 0.00% | 0.00% |
| | T | 99.99% | 99.98% | 99.95% | 99.86% | 96.08% | 99.56% | 84.95% | 89.78% | 99.43% |

| HEK2 pNMG-388/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.00% | 0.01% | 0.02% | 0.12% | 4.98% | 0.61% | 20.00% | 12.33% | 0.70% |
| | G | 0.00% | 0.00% | 0.00% | 0.00% | 0.01% | 0.00% | 0.00% | 0.00% | 0.00% |
| | T | 99.99% | 99.99% | 99.97% | 99.88% | 95.00% | 99.39% | 79.98% | 87.67% | 99.29% |

| HEK2 pNMG-389/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.02% | 0.01% | 0.01% | 0.01% | 0.01% |
| | C | 0.01% | 0.02% | 0.01% | 0.27% | 9.95% | 0.60% | 17.46% | 9.82% | 0.85% |
| | G | 0.01% | 0.00% | 0.00% | 0.00% | 0.01% | 0.01% | 0.00% | 0.00% | 0.00% |
| | T | 99.98% | 99.98% | 99.98% | 99.72% | 90.02% | 99.38% | 82.53% | 90.17% | 99.13% |

FIGURE 116

Hek2-2 site: 5'-GA₂A₃TA₅CTA₈A₉GCA₁₂TA₁₄GA₁₆CTCCAGG-3'

| HEK2-2 pNMG-370 | | 2 A | 3 A | 5 A | 8 A | 9 A | 12 A | 14 A | 16 A |
|---|---|---|---|---|---|---|---|---|---|
| | A | 99.81% | 99.60% | | 99.53% | 99.93% | 99.97% | 99.99% | 99.99% |
| | C | 0.02% | 0.01% | 0.01% | 0.01% | 0.01% | 0.01% | 0.01% | 0.00% |
| | G | 0.14% | 0.19% | | 0.46% | 0.06% | 0.01% | 0.00% | 0.01% |
| | T | 0.02% | 0.01% | 0.01% | 0.00% | 0.00% | 0.01% | 0.01% | 0.00% |

| HEK2-2 pNMG-371 | | 2 A | 3 A | 5 A | 8 A | 9 A | 12 A | 14 A | 16 A |
|---|---|---|---|---|---|---|---|---|---|
| | A | 99.47% | 99.28% | | 99.33% | 99.65% | 99.98% | 99.99% | 100.00% |
| | C | 0.02% | 0.00% | 0.00% | 0.00% | 0.00% | 0.00% | 0.00% | 0.00% |
| | G | 0.50% | 0.71% | | 0.66% | 0.35% | 0.01% | 0.01% | 0.00% |
| | T | 0.01% | 0.01% | 0.01% | 0.00% | 0.00% | 0.01% | 0.00% | 0.00% |

| HEK2-2 pNMG-382 | | 2 A | 3 A | 5 A | 8 A | 9 A | 12 A | 14 A | 16 A |
|---|---|---|---|---|---|---|---|---|---|
| | A | 99.91% | 99.88% | | 99.85% | 99.97% | 99.97% | 99.95% | 99.97% |
| | C | 0.03% | 0.01% | 0.01% | 0.03% | 0.02% | 0.02% | 0.04% | 0.01% |
| | G | 0.05% | 0.10% | | 0.12% | 0.01% | 0.01% | 0.01% | 0.00% |
| | T | 0.01% | 0.00% | 0.01% | 0.00% | 0.01% | 0.00% | 0.00% | 0.02% |

| HEK2-2 pNMG-383 | | 2 A | 3 A | 5 A | 8 A | 9 A | 12 A | 14 A | 16 A |
|---|---|---|---|---|---|---|---|---|---|
| | A | 99.91% | 99.97% | | 99.93% | 99.95% | 99.98% | 99.99% | 99.98% |
| | C | 0.01% | 0.00% | 0.00% | 0.00% | 0.00% | 0.00% | 0.00% | 0.00% |
| | G | 0.07% | 0.03% | | 0.07% | 0.04% | 0.01% | 0.01% | 0.01% |
| | T | 0.00% | 0.00% | 0.01% | 0.00% | 0.00% | 0.01% | 0.01% | 0.00% |

| HEK2-2 pNMG-384 | | 2 A | 3 A | 5 A | 8 A | 9 A | 12 A | 14 A | 16 A |
|---|---|---|---|---|---|---|---|---|---|
| | A | 99.92% | 99.99% | | 99.96% | 99.95% | 99.97% | 99.97% | 99.99% |
| | C | 0.02% | 0.01% | 0.01% | 0.01% | 0.01% | 0.01% | 0.01% | 0.01% |
| | G | 0.05% | 0.00% | | 0.03% | 0.04% | 0.01% | 0.01% | 0.00% |
| | T | 0.01% | 0.00% | 0.01% | 0.00% | 0.00% | 0.01% | 0.00% | 0.00% |

FIGURE 116 (Continued)

Hek2-2 site: 5'-GA₃A₁TA₅CTA₉A₄GCA₁₂TA₁₄GA₁₆CTCCAGG-3'

| HEK2-2 pNMG-385 | | 2 A | 3 A | 5 A | 8 A | 9 A | 12 A | 14 A | 16 A |
|---|---|---|---|---|---|---|---|---|---|
| | A | 99.95% | 99.99% | 88.71% | 99.96% | 99.99% | 99.99% | 99.99% | 99.99% |
| | C | 0.01% | 0.00% | 0.00% | 0.00% | 0.00% | 0.00% | 0.00% | 0.00% |
| | G | 0.04% | 0.01% | 11.29% | 0.03% | 0.01% | 0.00% | 0.01% | 0.00% |
| | T | 0.00% | 0.00% | 0.01% | 0.00% | 0.00% | 0.00% | 0.00% | 0.00% |

| HEK2-2 pNMG-386 | | 2 A | 3 A | 5 A | 8 A | 9 A | 12 A | 14 A | 16 A |
|---|---|---|---|---|---|---|---|---|---|
| | A | 99.92% | 99.95% | 79.64% | 99.88% | 99.96% | 99.95% | 99.97% | 99.98% |
| | C | 0.04% | 0.02% | 0.02% | 0.04% | 0.03% | 0.04% | 0.02% | 0.02% |
| | G | 0.03% | 0.02% | 20.34% | 0.08% | 0.00% | 0.00% | 0.01% | 0.00% |
| | T | 0.01% | 0.01% | 0.01% | 0.00% | 0.00% | 0.01% | 0.00% | 0.00% |

| HEK2-2 pNMG-387 | | 2 A | 3 A | 5 A | 8 A | 9 A | 12 A | 14 A | 16 A |
|---|---|---|---|---|---|---|---|---|---|
| | A | 99.86% | 99.93% | 78.42% | 99.82% | 99.94% | 99.98% | 99.98% | 99.98% |
| | C | 0.02% | 0.00% | 0.00% | 0.00% | 0.00% | 0.00% | 0.00% | 0.00% |
| | G | 0.11% | 0.06% | 21.56% | 0.17% | 0.05% | 0.01% | 0.01% | 0.01% |
| | T | 0.00% | 0.00% | 0.01% | 0.00% | 0.01% | 0.01% | 0.00% | 0.01% |

| HEK2-2 pNMG-388 | | 2 A | 3 A | 5 A | 8 A | 9 A | 12 A | 14 A | 16 A |
|---|---|---|---|---|---|---|---|---|---|
| | A | 99.87% | 99.88% | 76.34% | 99.90% | 99.96% | 99.98% | 99.98% | 99.98% |
| | C | 0.01% | 0.00% | 0.01% | 0.00% | 0.00% | 0.00% | 0.02% | 0.00% |
| | G | 0.12% | 0.12% | 23.64% | 0.09% | 0.01% | 0.01% | 0.00% | 0.00% |
| | T | 0.01% | 0.00% | 0.01% | 0.00% | 0.01% | 0.01% | 0.00% | 0.02% |

| HEK2-2 pNMG-389 | | 2 A | 3 A | 5 A | 8 A | 9 A | 12 A | 14 A | 16 A |
|---|---|---|---|---|---|---|---|---|---|
| | A | 99.82% | 99.95% | 76.46% | 99.90% | 99.97% | 99.99% | 99.98% | 99.99% |
| | C | 0.01% | 0.00% | 0.00% | 0.00% | 0.00% | 0.00% | 0.00% | 0.00% |
| | G | 0.16% | 0.04% | 23.37% | 0.10% | 0.02% | 0.01% | 0.01% | 0.00% |
| | T | 0.00% | 0.01% | 0.01% | 0.00% | 0.00% | 0.01% | 0.00% | 0.01% |

FIGURE 117

Hek 2-3 site: 5'-GTA A A CA A A GCA TA GA CTGAGGG -3'

| HEK2-3 pNMG-370 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.86% | 99.81% | 89.63% | 99.89% | 99.50% | 99.67% | 99.97% | 99.97% | 99.99% |
| | C | 0.00% | 0.01% | 0.01% | 0.01% | 0.01% | 0.14% | 0.01% | 0.02% | 0.00% |
| | G | 0.12% | 0.17% | 10.35% | 0.10% | 0.48% | 0.19% | 0.02% | 0.01% | 0.00% |
| | T | 0.01% | 0.01% | 0.01% | 0.01% | 0.01% | 0.00% | 0.01% | 0.00% | 0.01% |

| HEK2-3 pNMG-371 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.61% | 98.90% | 98.32% | 99.00% | 98.38% | 99.18% | 99.94% | 99.97% | 99.99% |
| | C | 0.00% | 0.01% | 0.00% | 0.00% | 0.00% | 0.13% | 0.00% | 0.01% | 0.00% |
| | G | 0.39% | 1.08% | 1.66% | 1.00% | 1.60% | 0.69% | 0.04% | 0.02% | 0.00% |
| | T | 0.00% | 0.01% | 0.01% | 0.00% | 0.01% | 0.00% | 0.02% | 0.00% | 0.01% |

| HEK2-3 pNMG-382 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | | 0.55% | 0.06% |
| | G | 0.01% | 0.00% | 0.00% | 0.00% | 0.00% | 0.00% | 0.02% | 0.00% | 0.00% |
| | T | 99.97% | 99.99% | 99.96% | 99.98% | 99.76% | 99.69% | | 99.45% | 99.94% |

| HEK2-3 pNMG-383 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | | 0.29% | 0.05% |
| | G | 0.01% | 0.00% | 0.00% | 0.00% | 0.01% | 0.00% | 0.01% | 0.00% | 0.00% |
| | T | 99.98% | 99.98% | 99.97% | 99.88% | 99.91% | 99.87% | | 99.69% | 99.94% |

| HEK2-3 pNMG-384 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.88% | | 99.88% | 99.97% |

| HEK2-3 pNMG-385 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | | 0.12% | 0.05% |
| | G | 0.01% | 0.00% | 0.00% | 0.00% | 0.01% | 0.00% | 0.01% | 0.00% | 0.00% |
| | T | 99.99% | 99.98% | 99.98% | 99.99% | 99.92% | 99.91% | | 99.88% | 99.95% |

FIGURE 117 (Continued)

Hek 2-3 site: 5'-GTA₃A₄A₅CA₇A₈A₉GCA₁₂TA₁₄GA₁₆CTGAGGG -3'

| HEK2-3 pNMG-386 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | | 0.80% | 0.04% |
| | G | 0.01% | 0.00% | 0.00% | 0.00% | 0.01% | 0.00% | 0.01% | 0.00% | 0.00% |
| | T | 99.97% | | | 99.93% | 99.54% | 99.87% | | 99.20% | |

| HEK2-3 pNMG-387 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | | 0.53% | 0.02% |
| | G | 0.00% | 0.00% | 0.00% | 0.00% | 0.01% | 0.00% | 0.01% | 0.00% | 0.00% |
| | T | | | | | | | | | |

| HEK2-3 pNMG-388 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | | 0.55% | 0.07% |
| | G | 0.00% | 0.00% | 0.00% | 0.00% | 0.01% | 0.00% | 0.01% | 0.00% | 0.00% |
| | T | | | | | | | | | |

| HEK2-3 pNMG-389 | | 3 A | 4 A | 5 A | 7 A | 8 A | 9 A | 12 A | 14 A | 16 A |
|---|---|---|---|---|---|---|---|---|---|---|
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | | 0.40% | 0.07% |
| | G | 0.00% | 0.00% | 0.00% | 0.00% | 0.00% | 0.01% | 0.01% | 0.00% | 0.00% |
| | T | | | | | 99.79% | 99.77% | | 99.60% | |

FIGURE 118

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-370 | | 2 | 3 | 5 | 8 | 9 | 12 | 14 | 16 |
|---|---|---|---|---|---|---|---|---|---|
| | | A | A | A | A | A | A | A | A |
| | A | 99.96% | 99.94% | 95.58% | 99.77% | 99.84% | 99.96% | 99.98% | 99.97% |
| | C | 0.00% | 0.01% | 0.01% | 0.01% | 0.01% | 0.01% | 0.00% | 0.02% |
| | G | 0.03% | 0.04% | 4.40% | 0.21% | 0.14% | 0.02% | 0.02% | 0.01% |
| | T | 0.01% | 0.01% | 0.01% | 0.01% | 0.02% | 0.01% | 0.01% | 0.01% |

| HEK2-6 pNMG-371 | | 2 | 3 | 5 | 8 | 9 | 12 | 14 | 16 |
|---|---|---|---|---|---|---|---|---|---|
| | | A | A | A | A | A | A | A | A |
| | A | 99.95% | 99.91% | 92.37% | 99.60% | 99.63% | 99.98% | 99.99% | 99.99% |
| | C | 0.00% | 0.00% | 0.00% | 0.00% | 0.00% | 0.00% | 0.00% | 0.01% |
| | G | 0.04% | 0.08% | 7.61% | 0.39% | 0.35% | 0.01% | 0.01% | 0.00% |
| | T | 0.01% | 0.01% | 0.02% | 0.01% | 0.01% | 0.00% | 0.01% | 0.00% |

| HEK2-6 pNMG-382 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.97% | 95.39% | 99.88% | 99.90% | 99.99% | 99.99% | 99.96% |
| | C | 0.00% | 0.01% | 0.01% | 0.01% | 0.01% | 0.00% | 0.00% | 0.01% |
| | G | 0.03% | 0.01% | 4.59% | 0.10% | 0.08% | 0.01% | 0.00% | 0.02% |
| | T | 0.01% | 0.01% | 0.01% | 0.01% | 0.01% | 0.00% | 0.01% | 0.01% |

| HEK2-6 pNMG-383 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.97% | 94.48% | 99.97% | 99.90% | 99.94% | 99.97% | 99.98% |
| | C | 0.00% | 0.01% | 0.00% | 0.00% | 0.01% | 0.00% | 0.01% | 0.01% |
| | G | 0.02% | 0.01% | 5.50% | 0.03% | 0.07% | 0.04% | 0.01% | 0.00% |
| | T | 0.00% | 0.01% | 0.02% | 0.00% | 0.02% | 0.01% | 0.01% | 0.01% |

| HEK2-6 pNMG-384 | | 2 | 3 | 5 | 8 | 9 | 12 | 14 | 16 |
|---|---|---|---|---|---|---|---|---|---|
| | | A | A | A | A | A | A | A | A |
| | A | 99.96% | 99.97% | 97.20% | 99.98% | 99.38% | 99.97% | 99.98% | 99.97% |
| | C | 0.00% | 0.01% | 0.00% | 0.00% | 0.01% | 0.01% | 0.00% | 0.01% |
| | G | 0.03% | 0.01% | 2.79% | 0.01% | 0.04% | 0.01% | 0.01% | 0.01% |
| | T | 0.00% | 0.01% | 0.01% | 0.00% | 0.02% | 0.01% | 0.01% | 0.00% |

FIGURE 118 (Continued)

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-385 | | 2<br>A | 3<br>A | 5<br>A | 8<br>A | 9<br>A | 12<br>A | 14<br>A | 16<br>A |
|---|---|---|---|---|---|---|---|---|---|
| | A | 99.96% | 99.97% | 98.54% | 99.98% | 99.97% | 99.97% | 99.95% | 99.98% |
| | C | 0.00% | 0.01% | 0.01% | 0.00% | 0.01% | 0.00% | 0.01% | 0.00% |
| | G | 0.02% | 0.01% | 1.45% | 0.01% | 0.02% | 0.01% | 0.03% | 0.01% |
| | T | 0.01% | 0.01% | 0.01% | 0.01% | 0.00% | 0.02% | 0.01% | 0.01% |

| HEK2-6 pNMG-386 | | 2<br>A | 3<br>A | 5<br>A | 8<br>A | 9<br>A | 12<br>A | 14<br>A | 16<br>A |
|---|---|---|---|---|---|---|---|---|---|
| | A | 99.98% | 99.97% | 97.56% | 99.95% | 99.93% | 99.95% | 99.96% | 99.97% |
| | C | 0.01% | 0.01% | 0.01% | 0.02% | 0.02% | 0.01% | 0.01% | 0.02% |
| | G | 0.01% | 0.01% | 2.41% | 0.02% | 0.04% | 0.03% | 0.02% | 0.00% |
| | T | 0.00% | 0.01% | 0.01% | 0.01% | 0.01% | 0.00% | 0.02% | 0.00% |

| HEK2-6 pNMG-387 | | 2<br>A | 3<br>A | 5<br>A | 8<br>A | 9<br>A | 12<br>A | 14<br>A | 16<br>A |
|---|---|---|---|---|---|---|---|---|---|
| | A | 99.93% | 99.97% | 97.46% | 99.94% | 99.97% | 99.98% | 99.97% | 99.98% |
| | C | 0.01% | 0.01% | 0.00% | 0.01% | 0.01% | 0.00% | 0.00% | 0.01% |
| | G | 0.05% | 0.01% | 2.53% | 0.05% | 0.02% | 0.01% | 0.01% | 0.01% |
| | T | 0.01% | 0.01% | 0.01% | 0.00% | 0.01% | 0.01% | 0.01% | 0.00% |

| HEK2-6 pNMG-388 | | 2<br>A | 3<br>A | 5<br>A | 8<br>A | 9<br>A | 12<br>A | 14<br>A | 16<br>A |
|---|---|---|---|---|---|---|---|---|---|
| | A | 99.97% | 99.98% | 96.81% | 99.94% | 99.90% | 99.94% | 99.99% | 99.99% |
| | C | 0.00% | 0.01% | 0.01% | 0.00% | 0.00% | 0.00% | 0.00% | 0.00% |
| | G | 0.02% | 0.01% | 3.18% | 0.06% | 0.08% | 0.06% | 0.00% | 0.00% |
| | T | 0.01% | 0.01% | 0.00% | 0.00% | 0.01% | 0.01% | 0.01% | 0.00% |

| HEK2-6 pNMG-389 | | 2<br>A | 3<br>A | 5<br>A | 8<br>A | 9<br>A | 12<br>A | 14<br>A | 16<br>A |
|---|---|---|---|---|---|---|---|---|---|
| | A | 99.97% | 99.96% | 97.46% | 99.97% | 99.85% | 99.89% | 99.97% | 99.97% |
| | C | 0.00% | 0.01% | 0.00% | 0.00% | 0.02% | 0.00% | 0.00% | 0.02% |
| | G | 0.02% | 0.02% | 2.51% | 0.03% | 0.13% | 0.10% | 0.01% | 0.01% |
| | T | 0.01% | 0.02% | 0.03% | 0.00% | 0.01% | 0.01% | 0.02% | 0.00% |

FIGURE 119
HEK2-7- 3'-CCTGCAGT CAAT GAT T T GT T T T G-5'

| HEK2-7 pNMG-370 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.01% | 0.01% | 0.01% | 0.00% | 0.00% | 0.01% |
| | C | 0.02% | 0.01% | 0.04% | 0.02% | 0.01% | 0.30% | 0.01% | 0.01% | 0.01% |
| | G | 0.00% | 0.00% | 0.00% | 0.00% | 0.00% | 0.00% | 0.00% | 0.00% | 0.00% |
| | T | 99.98% | 99.98% | 99.96% | 99.96% | 99.98% | 99.69% | 99.99% | 99.99% | 99.98% |

| HEK2-7 pNMG-371 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.00% | 0.00% | 0.00% | 0.00% |
| | C | 0.02% | 0.01% | 0.07% | 0.05% | 0.05% | 0.75% | 0.04% | 0.02% | 0.01% |
| | G | 0.00% | 0.00% | 0.00% | 0.00% | 0.00% | 0.00% | 0.00% | 0.00% | 0.00% |
| | T | 99.98% | 99.98% | 99.92% | 99.95% | 99.94% | 99.24% | 99.96% | 99.98% | 99.99% |

| HEK2-7 pNMG-382 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.01% | 0.01% | 0.00% | 0.00% | 0.00% |
| | C | 0.01% | 0.01% | 0.01% | 0.01% | 0.00% | 0.26% | 0.01% | 0.01% | 0.01% |
| | G | 0.00% | 0.00% | 0.00% | 0.00% | 0.00% | 0.00% | 0.00% | 0.00% | 0.00% |
| | T | 99.99% | 99.99% | 99.99% | 99.99% | 99.99% | 99.74% | 99.99% | 99.99% | 99.99% |

| HEK2-7 pNMG-383 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.01% | 0.01% | 0.01% | 0.02% | 0.01% | 0.23% | 0.01% | 0.01% | 0.00% |
| | G | 0.00% | 0.01% | 0.00% | 0.00% | 0.00% | 0.01% | 0.00% | 0.00% | 0.00% |
| | T | 99.99% | 99.98% | 99.99% | 99.98% | 99.99% | 99.76% | 99.98% | 99.99% | 99.99% |

| HEK2-7 pNMG-384 | | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.00% | 0.00% | 0.01% | 0.00% | 0.00% | 0.00% |
| | C | 0.01% | 0.01% | 0.02% | 0.00% | 0.01% | 0.10% | 0.01% | 0.02% | 0.01% |
| | G | 0.00% | 0.00% | 0.00% | 0.00% | 0.00% | 0.01% | 0.00% | 0.00% | 0.00% |
| | T | 99.99% | 99.98% | 99.98% | 99.99% | 99.99% | 99.89% | 99.99% | 99.98% | 99.99% |

FIGURE 119 (Continued)

HEK2-7- 3'-CCTGCAGT CAAT GAT T T GT T T T G-5'

| HEK2-7 pNMG-385 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.00% | 0.00% | 0.01% | 0.00% | 0.00% | 0.00% | 0.00% | 0.00% |
| | C | 0.01% | 0.01% | 0.01% | 0.02% | 0.00% | 0.09% | 0.02% | 0.01% | 0.01% |
| | G | 0.00% | 0.01% | 0.00% | 0.00% | 0.00% | 0.01% | 0.00% | 0.00% | 0.00% |
| | T | 99.99% | 99.97% | 99.99% | 99.97% | 100.00% | 99.91% | 99.98% | 99.99% | 99.99% |

| HEK2-7 pNMG-386 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.00% | 0.00% | 0.01% | 0.00% | 0.00% | 0.00% |
| | C | 0.01% | 0.01% | 0.02% | 0.01% | 0.01% | 0.14% | 0.01% | 0.01% | 0.00% |
| | G | 0.00% | 0.00% | 0.00% | 0.00% | 0.00% | 0.00% | 0.00% | 0.00% | 0.00% |
| | T | 99.98% | 99.99% | 99.98% | 99.99% | 99.98% | 99.85% | 99.99% | 99.99% | 99.99% |

| HEK2-7 pNMG-387 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.00% | 0.00% | 0.00% | 0.01% | 0.00% | 0.01% | 0.00% | 0.00% |
| | C | 0.01% | 0.01% | 0.02% | 0.02% | 0.01% | 0.14% | 0.01% | 0.02% | 0.01% |
| | G | 0.00% | 0.01% | 0.00% | 0.00% | 0.00% | 0.01% | 0.00% | 0.00% | 0.00% |
| | T | 99.99% | 99.98% | 99.98% | 99.98% | 99.98% | 99.85% | 99.98% | 99.97% | 99.99% |

| HEK2-7 pNMG-388 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.00% | 0.00% | 0.00% | 0.00% | 0.00% | 0.00% | 0.00% | 0.00% | 0.00% |
| | C | 0.02% | 0.02% | 0.00% | 0.02% | 0.02% | 0.38% | 0.05% | 0.00% | 0.03% |
| | G | 0.00% | 0.00% | 0.00% | 0.00% | 0.00% | 0.00% | 0.00% | 0.01% | 0.02% |
| | T | 99.98% | 99.97% | 99.99% | 99.98% | 99.98% | 99.62% | 99.95% | 99.99% | 99.95% |

| HEK2-7 pNMG-389 | | 16 | 12 | 9 | 8 | 7 | 5 | 4 | 3 | 2 |
|---|---|---|---|---|---|---|---|---|---|---|
| | | T | T | T | T | T | T | T | T | T |
| | A | 0.01% | 0.00% | 0.00% | 0.00% | 0.00% | 0.00% | 0.00% | 0.00% | 0.01% |
| | C | 0.02% | 0.01% | 0.02% | 0.02% | 0.01% | 0.27% | 0.02% | 0.01% | 0.01% |
| | G | 0.00% | 0.01% | 0.00% | 0.00% | 0.01% | 0.00% | 0.00% | 0.00% | 0.00% |
| | T | 99.98% | 99.98% | 99.98% | 99.97% | 99.98% | 99.72% | 99.98% | 99.99% | 99.99% |

FIGURE 120

Hek2-10 site: 3'-CCATCAT₁₇T₁₆CT₁₄AT₁₂T₁₁CT₉T₈T₇AT₅GT₃T₂C-5'

| HEK2-10 pNMG-370 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.05% | 0.01% | 0.00% | 0.00% | 0.00% | 0.00% | 0.01% | 0.01% | 0.00% | 0.01% |
| | C | 0.01% | 0.01% | 0.02% | 0.19% | 0.22% | 0.19% | 0.57% | 0.94% | 6.27% | 0.53% | 0.26% |
| | G | 0.02% | 0.00% | 0.00% | 0.00% | 0.02% | 0.00% | 0.00% | 0.00% | 0.00% | 0.00% | 0.00% |
| | T | | | | | | | | | | | |

| HEK2-10 pNMG-371 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.01% | 0.01% | 0.00% | 0.00% | 0.01% | 0.00% | 0.01% | 0.01% | 0.00% | 0.00% |
| | C | 0.01% | 0.01% | 0.01% | 0.09% | 0.69% | 0.73% | 2.06% | 3.06% | | 2.52% | 0.53% |
| | G | 0.02% | 0.00% | 0.01% | 0.00% | 0.02% | 0.00% | 0.00% | 0.00% | 0.01% | 0.00% | 0.00% |
| | T | | | | | | | | | | | |

| HEK2-10 pNMG-382 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.00% | 0.01% | 0.01% | 0.00% | 0.00% | 0.01% | 0.00% | 0.01% | 0.00% |
| | C | 0.01% | 0.01% | 0.01% | 0.23% | 0.18% | 0.03% | 0.33% | 0.23% | 3.62% | 0.29% | 0.31% |
| | G | 0.02% | 0.00% | 0.01% | 0.00% | 0.02% | 0.00% | 0.00% | 0.00% | 0.00% | 0.00% | 0.00% |
| | T | | | | | | | | | | | |

| HEK2-10 pNMG-383 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.01% | 0.01% | 0.01% | 0.00% | 0.01% | 0.00% | 0.00% | 0.00% | 0.01% | 0.01% |
| | C | 0.01% | 0.01% | 0.01% | 0.05% | 0.75% | 0.08% | 0.15% | 0.20% | 3.71% | 0.19% | 0.12% |
| | G | 0.02% | 0.00% | 0.00% | 0.00% | 0.02% | 0.00% | 0.00% | 0.00% | 0.00% | 0.00% | 0.00% |
| | T | | | | | | | | | | | |

| HEK2-10 pNMG-384 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.01% | 0.01% | 0.01% | 0.00% | 0.00% | 0.01% | 0.01% | 0.01% |
| | C | 0.01% | 0.01% | 0.01% | 0.11% | 0.83% | 0.04% | 0.13% | 0.11% | 3.14% | 0.12% | 0.14% |
| | G | 0.02% | 0.00% | 0.00% | 0.00% | 0.02% | 0.00% | 0.00% | 0.00% | 0.00% | 0.00% | 0.00% |
| | T | | | | | | | | | | | |

FIGURE 120 (Continued)

Hek2-10 site: 3'-CCATCAT$_{17}$T$_{16}$CT$_{14}$AT$_{12}$T$_{11}$CT$_9$T$_8$T$_7$AT$_5$GT$_3$T$_2$C-5'

| HEK2-10 pNMG-385 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.00% | 0.00% | 0.00% | 0.01% | 0.00% | 0.00% | 0.01% | 0.01% | 0.00% |
| | C | 0.01% | 0.01% | 0.01% | 0.06% | 0.28% | 0.03% | 0.09% | 0.10% | 1.52% | 0.05% | 0.11% |
| | G | 0.02% | 0.00% | 0.00% | 0.00% | 0.02% | 0.00% | 0.00% | 0.00% | 0.00% | 0.00% | 0.00% |
| | T | 99.97% | 99.97% | 99.99% | 99.94% | 99.70% | 99.96% | 99.91% | 99.90% | 98.47% | 99.94% | 99.89% |

| HEK2-10 pNMG-386 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.01% | 0.00% | 0.01% | 0.01% | 0.01% | 0.00% | 0.01% | 0.01% | 0.01% |
| | C | 0.01% | 0.01% | 0.01% | 0.24% | 0.70% | 0.05% | 0.27% | 0.10% | 2.78% | 0.11% | 0.23% |
| | G | 0.01% | 0.00% | 0.01% | 0.00% | 0.01% | 0.00% | 0.00% | 0.00% | 0.00% | 0.00% | 0.00% |
| | T | 99.98% | 99.92% | 99.97% | 99.76% | 99.28% | 99.94% | 99.72% | 99.90% | 97.21% | 99.88% | 99.76% |

| HEK2-10 pNMG-387 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.05% | 0.00% | 0.01% | 0.00% | 0.00% | 0.00% | 0.00% | 0.01% | 0.01% | 0.00% |
| | C | 0.01% | 0.01% | 0.01% | 0.26% | 0.18% | 0.08% | 0.38% | 0.19% | 3.15% | 0.21% | 0.39% |
| | G | 0.01% | 0.00% | 0.01% | 0.00% | 0.02% | 0.00% | 0.00% | 0.01% | 0.00% | 0.00% | 0.00% |
| | T | 99.97% | 99.95% | 99.98% | 99.74% | 99.80% | 99.92% | 99.62% | 99.80% | 96.83% | 99.78% | 99.61% |

| HEK2-10 pNMG-388 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.03% | 0.00% | 0.00% | 0.00% | 0.00% | 0.00% | 0.00% | 0.01% | 0.01% | 0.01% |
| | C | 0.01% | 0.01% | 0.01% | 0.13% | 0.16% | 0.05% | 0.25% | 0.24% | 4.14% | 0.22% | 0.22% |
| | G | 0.01% | 0.00% | 0.00% | 0.00% | 0.01% | 0.00% | 0.00% | 0.00% | 0.00% | 0.00% | 0.00% |
| | T | 99.98% | 99.96% | 99.99% | 99.87% | 99.83% | 99.95% | 99.75% | 99.76% | 95.85% | 99.77% | 99.77% |

| HEK2-10 pNMG-389 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.00% | 0.00% | 0.01% | 0.00% | 0.00% | 0.00% | 0.00% | 0.01% |
| | C | 0.01% | 0.01% | 0.01% | 0.09% | 0.23% | 0.06% | 0.18% | 0.23% | 3.10% | 0.15% | 0.21% |
| | G | 0.01% | 0.00% | 0.01% | 0.00% | 0.01% | 0.00% | 0.00% | 0.00% | 0.00% | 0.00% | 0.00% |
| | T | 99.98% | 99.97% | 99.97% | 99.91% | 99.76% | 99.93% | 99.82% | 99.77% | 96.90% | 99.84% | 99.78% |

FIGURE 121

Hek3- 5'-GGCCCA GA CTGA GCA CGTGATGG-3'
          6    8   12   15

| HEK3 pNMG-370 | | 6 A | 8 A | 12 A | 15 A |
|---|---|---|---|---|---|
| | A | 98.95% | 97.52% | 99.96% | 99.97% |
| | C | 0.01% | 0.01% | 0.01% | 0.02% |
| | G | 1.04% | 2.46% | 0.04% | 0.01% |
| | T | 0.00% | 0.01% | 0.00% | 0.00% |

| HEK3 pNMG-371 | | 6 A | 8 A | 12 A | 15 A |
|---|---|---|---|---|---|
| | A | 98.05% | 95.72% | 99.97% | 99.99% |
| | C | 0.00% | 0.00% | 0.00% | 0.00% |
| | G | 1.95% | 4.25% | 0.03% | 0.01% |
| | T | 0.00% | 0.00% | 0.00% | 0.00% |

| HEK3 pNMG-382 | | 6 A | 8 A | 12 A | 15 A |
|---|---|---|---|---|---|
| | A | 99.39% | 97.01% | 99.93% | 99.98% |
| | C | 0.01% | 0.01% | 0.01% | 0.01% |
| | G | 0.60% | 2.98% | 0.05% | 0.00% |
| | T | 0.00% | 0.00% | 0.00% | 0.00% |

| HEK3 pNMG-383 | | 6 A | 8 A | 12 A | 15 A |
|---|---|---|---|---|---|
| | A | 99.49% | 97.31% | 99.95% | 99.99% |
| | C | 0.00% | 0.00% | 0.00% | 0.00% |
| | G | 0.50% | 2.68% | 0.04% | 0.01% |
| | T | 0.01% | 0.00% | 0.00% | 0.00% |

| HEK3 pNMG-384 | | 6 A | 8 A | 12 A | 15 A |
|---|---|---|---|---|---|
| | A | 99.70% | 98.13% | 99.96% | 99.98% |
| | C | 0.01% | 0.01% | 0.01% | 0.01% |
| | G | 0.28% | 1.83% | 0.03% | 0.01% |
| | T | 0.01% | 0.01% | 0.00% | 0.00% |

| HEK3 pNMG-385 | | 6 A | 8 A | 12 A | 15 A |
|---|---|---|---|---|---|
| | A | 99.73% | 98.91% | 99.98% | 99.99% |
| | C | 0.00% | 0.00% | 0.00% | 0.00% |
| | G | 0.25% | 1.06% | 0.02% | 0.01% |
| | T | 0.01% | 0.01% | 0.00% | 0.00% |

| HEK3 pNMG-385 | | 6 A | 8 A | 12 A | 15 A |
|---|---|---|---|---|---|
| | A | 99.73% | 98.91% | 99.98% | 99.99% |
| | C | 0.00% | 0.00% | 0.00% | 0.00% |
| | G | 0.25% | 1.06% | 0.02% | 0.01% |
| | T | 0.01% | 0.01% | 0.00% | 0.00% |

| HEK3 pNMG-386 | | 6 A | 8 A | 12 A | 15 A |
|---|---|---|---|---|---|
| | A | 99.56% | 97.94% | 99.94% | 99.95% |
| | C | 0.03% | 0.02% | 0.03% | 0.03% |
| | G | 0.41% | 2.04% | 0.03% | 0.01% |
| | T | 0.00% | 0.00% | 0.00% | 0.01% |

| HEK3 pNMG-387 | | 6 A | 8 A | 12 A | 15 A |
|---|---|---|---|---|---|
| | A | 99.64% | 97.13% | 99.95% | 99.97% |
| | C | 0.00% | 0.00% | 0.01% | 0.00% |
| | G | 0.36% | 2.86% | 0.04% | 0.01% |
| | T | 0.00% | 0.01% | 0.00% | 0.01% |

| HEK3 pNMG-388 | | 6 A | 8 A | 12 A | 15 A |
|---|---|---|---|---|---|
| | A | 99.39% | 97.54% | 99.94% | 99.98% |
| | C | 0.00% | 0.00% | 0.00% | 0.00% |
| | G | 0.59% | 2.45% | 0.05% | 0.01% |
| | T | 0.01% | 0.01% | 0.00% | 0.01% |

| HEK3 pNMG-389 | | 6 A | 8 A | 12 A | 15 A |
|---|---|---|---|---|---|
| | A | 99.53% | 97.37% | 99.96% | 99.98% |
| | C | 0.01% | 0.00% | 0.00% | 0.00% |
| | G | 0.46% | 2.63% | 0.03% | 0.01% |
| | T | 0.01% | 0.01% | 0.00% | 0.01% |

FIGURE 122

FANCF- 5'-GGA A TCCCTTCTGCA GCA CCTGG-3'

| FANCF pNMG-378 | | 3 A | 4 A | 15 A | 18 A |
|---|---|---|---|---|---|
| | A | 99.93% | 99.40% | 99.99% | 99.98% |
| | C | 0.00% | 0.00% | 0.00% | 0.00% |
| | G | 0.06% | 0.60% | 0.01% | 0.01% |
| | T | 0.01% | 0.00% | 0.00% | 0.00% |

| FANCF pNMG-385 | | 3 A | 4 A | 15 A | 18 A |
|---|---|---|---|---|---|
| | A | 99.93% | 99.82% | 99.99% | 99.98% |
| | C | 0.00% | 0.00% | 0.00% | 0.00% |
| | G | 0.04% | 0.17% | 0.00% | 0.00% |
| | T | 0.02% | 0.01% | 0.00% | 0.01% |

| FANCF pNMG-373 | | 3 A | 4 A | 15 A | 18 A |
|---|---|---|---|---|---|
| | A | 99.67% | 97.88% | 99.98% | 99.98% |
| | C | 0.00% | 0.00% | 0.00% | 0.00% |
| | G | 0.32% | 2.11% | 0.01% | 0.01% |
| | T | 0.01% | 0.00% | 0.00% | 0.01% |

| FANCF pNMG-386 | | 3 A | 4 A | 15 A | 18 A |
|---|---|---|---|---|---|
| | A | 99.93% | 99.82% | 99.99% | 99.98% |
| | C | 0.00% | 0.00% | 0.00% | 0.00% |
| | G | 0.05% | 0.17% | 0.01% | 0.00% |
| | T | 0.01% | 0.01% | 0.00% | 0.01% |

| FANCF pNMG-382 | | 3 A | 4 A | 15 A | 18 A |
|---|---|---|---|---|---|
| | A | 99.93% | 99.68% | 99.99% | 99.98% |
| | C | 0.00% | 0.00% | 0.00% | 0.00% |
| | G | 0.06% | 0.30% | 0.01% | 0.00% |
| | T | 0.00% | 0.01% | 0.00% | 0.01% |

| FANCF pNMG-387 | | 3 A | 4 A | 15 A | 18 A |
|---|---|---|---|---|---|
| | A | 99.93% | 99.74% | 99.98% | 99.98% |
| | C | 0.00% | 0.00% | 0.00% | 0.00% |
| | G | 0.05% | 0.25% | 0.01% | 0.01% |
| | T | 0.01% | 0.00% | 0.00% | 0.00% |

| FANCF pNMG-383 | | 3 A | 4 A | 15 A | 18 A |
|---|---|---|---|---|---|
| | A | 99.93% | 99.78% | 99.98% | 99.98% |
| | C | 0.00% | 0.00% | 0.00% | 0.00% |
| | G | 0.05% | 0.23% | 0.02% | 0.01% |
| | T | 0.00% | 0.00% | 0.00% | 0.01% |

| FANCF pNMG-388 | | 3 A | 4 A | 15 A | 18 A |
|---|---|---|---|---|---|
| | A | 99.93% | 99.68% | 99.98% | 99.98% |
| | C | 0.00% | 0.00% | 0.00% | 0.00% |
| | G | 0.05% | 0.31% | 0.01% | 0.01% |
| | T | 0.01% | 0.00% | 0.00% | 0.01% |

| FANCF pNMG-384 | | 3 A | 4 A | 15 A | 18 A |
|---|---|---|---|---|---|
| | A | 99.93% | 99.82% | 99.99% | 99.98% |
| | C | 0.00% | 0.00% | 0.00% | 0.00% |
| | G | 0.06% | 0.16% | 0.01% | 0.00% |
| | T | 0.01% | 0.01% | 0.00% | 0.01% |

| FANCF pNMG-389 | | 3 A | 4 A | 15 A | 18 A |
|---|---|---|---|---|---|
| | A | 99.92% | 99.85% | 99.98% | 99.98% |
| | C | 0.00% | 0.00% | 0.00% | 0.00% |
| | G | 0.08% | 0.14% | 0.01% | 0.00% |
| | T | 0.00% | 0.00% | 0.00% | 0.01% |

| Site | Protospacer and PAM sequence | pNMG370 | pNMG371 | pNMG382-389 | | | | | | |
|---|---|---|---|---|---|---|---|---|---|---|
| HEK2 | GAACACAAAGCATAGACTGCTGG | 54.0 | 65.4 | 48.4 | 52.9 | 44.6 | 40.3 | 41.0 | 44.8 | 43.6 | 40.6 |
| HEK2-2 | GAATACTAAGCATAGACTCCAGG | 29.1 | 50.1 | 24.5 | 23.8 | 21.8 | 11.3 | 20.5 | 21.6 | 23.6 | 23.4 |
| HEK2-3 | GTAAACAAAGCATAGACTGAGGG | 10.4 | 20.1 | 8.2 | 11.0 | 4.7 | 3.5 | 8.0 | 4.2 | 8.5 | 6.2 |
| HEK2-6 | GAAGACCAAGGATAGACTGCTGG | 4.4 | 7.6 | 4.6 | 5.5 | 2.8 | 1.4 | 2.4 | 2.5 | 3.2 | 2.5 |
| HEK2-7 | GAAAACAAATCATTGACTGCAGG | 0.3 | 0.7 | 0.3 | 0.2 | 0.1 | 0.1 | 0.1 | 0.1 | 0.4 | 0.3 |
| HEK2-10 | GAACATAAAGAATAGAATGATGG | 6.3 | 21.4 | 3.6 | 6.3 | 4.6 | 2.0 | 4.2 | 4.1 | 5.5 | 4.0 |

382 ⟶ 389

FIGURE 12.5

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-339 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.8% | 95.9% | 44.1% | 98.4% | 98.5% | 99.3% | 99.9% | 100.0% | 100.0% |
| | C | 0.0% | 0.0% | 0.0% | 0.0% | 0.0% | 0.0% | 0.0% | 0.0% | 0.0% |
| | G | 0.2% | 4.1% | 55.8% | 1.6% | 1.5% | 0.7% | 0.0% | 0.0% | 0.0% |
| | T | 0.0% | 0.0% | 0.0% | 0.0% | 0.0% | 0.0% | 0.0% | 0.0% | 0.0% |

| HEK2 pNMG-340 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.89% | 97.86% | 34.81% | 99.43% | 98.96% | 99.54% | 99.98% | 99.99% | 99.99% |
| | C | 0.00% | 0.00% | 0.00% | 0.00% | 0.00% | 0.00% | 0.00% | 0.00% | 0.00% |
| | G | 0.10% | 2.12% | 65.18% | 0.56% | 1.02% | 0.45% | 0.01% | 0.01% | 0.01% |
| | T | 0.00% | 0.00% | 0.01% | 0.00% | 0.01% | 0.00% | 0.00% | 0.00% | 0.00% |

| HEK2 pNMG-341 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.80% | 94.79% | 28.75% | 98.16% | 98.08% | 99.02% | 99.92% | 99.96% | 99.99% |
| | C | 0.00% | 0.01% | 0.00% | 0.00% | 0.00% | 0.00% | 0.00% | 0.00% | 0.00% |
| | G | 0.19% | 5.19% | 71.23% | 1.84% | 1.91% | 0.98% | 0.07% | 0.02% | 0.01% |
| | T | 0.00% | 0.01% | 0.01% | 0.00% | 0.00% | 0.00% | 0.00% | 0.01% | 0.00% |

| HEK2 pNMG-346 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.88% | 93.08% | 99.94% | 99.98% | 99.89% | 99.99% | 99.98% | 99.98% |
| | C | 0.00% | 0.01% | 0.00% | 0.00% | 0.00% | 0.00% | 0.00% | 0.00% | 0.00% |
| | G | 0.02% | 0.10% | 6.91% | 0.04% | 0.01% | 0.10% | 0.01% | 0.01% | 0.01% |
| | T | 0.00% | 0.00% | 0.01% | 0.02% | 0.01% | 0.00% | 0.01% | 0.00% | 0.00% |

| HEK2 pNMG-347 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.66% | 87.50% | 99.88% | 99.86% | 99.74% | 99.99% | 99.99% | 99.99% |
| | C | 0.00% | 0.01% | 0.00% | 0.00% | 0.00% | 0.00% | 0.00% | 0.00% | 0.00% |
| | G | 0.03% | 0.31% | 12.49% | 0.11% | 0.13% | 0.26% | 0.01% | 0.01% | 0.01% |
| | T | 0.01% | 0.00% | 0.01% | 0.00% | 0.00% | 0.00% | 0.01% | 0.00% | 0.00% |

| HEK2 pNMG-348 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.99% | 99.72% | 84.88% | 99.93% | 99.93% | 99.90% | 99.92% | 99.98% | 99.99% |
| | C | 0.00% | 0.00% | 0.00% | 0.00% | 0.00% | 0.00% | 0.00% | 0.00% | 0.00% |
| | G | 0.01% | 0.27% | 15.10% | 0.06% | 0.06% | 0.10% | 0.07% | 0.02% | 0.01% |
| | T | 0.00% | 0.01% | 0.01% | 0.00% | 0.00% | 0.00% | 0.00% | 0.01% | 0.00% |

| HEK2 pNMG-349 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.98% | 99.71% | 85.59% | 99.94% | 99.84% | 99.92% | 99.97% | 99.97% | 99.98% |
| | C | 0.00% | 0.00% | 0.00% | 0.00% | 0.00% | 0.00% | 0.00% | 0.00% | 0.00% |
| | G | 0.02% | 0.28% | 14.40% | 0.05% | 0.15% | 0.07% | 0.02% | 0.02% | 0.01% |
| | T | 0.00% | 0.00% | 0.01% | 0.00% | 0.01% | 0.00% | 0.01% | 0.01% | 0.00% |

FIGURE 130

Hek 2-1 site: 5'-GA$_2$A$_3$A$_4$A$_5$A$_6$A$_7$A$_8$A$_9$GCA$_{12}$GA$_{14}$GACTGCTGG-3'

| HEK2-1 pNMG-339 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.98% | 99.97% | 99.90% | 99.97% | 99.98% | 99.98% | 99.97% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.03% | 0.10% | 0.03% | 0.01% | 0.01% | 0.02% | 0.02% | 0.01% |
| | T | 0.00% | 0.00% | 0.00% | 0.00% | 0.00% | 0.00% | 0.01% | 0.00% | 0.01% | 0.01% |

| HEK2-1 pNMG-340 | | 2 A | 3 A | 4 A | 5 A | 6 A | 7 A | 8 A | 9 A | 12 A | 14 A |
|---|---|---|---|---|---|---|---|---|---|---|---|
| | A | 99.98% | 99.98% | 99.98% | 99.88% | 99.96% | 99.98% | 99.99% | 99.97% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.01% | 0.11% | 0.02% | 0.01% | 0.01% | 0.03% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-341 | | 2 A | 3 A | 4 A | 5 A | 6 A | 7 A | 8 A | 9 A | 12 A | 14 A |
|---|---|---|---|---|---|---|---|---|---|---|---|
| | A | 99.98% | 99.97% | 99.94% | 99.80% | 99.93% | 99.98% | 99.98% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.05% | 0.20% | 0.07% | 0.01% | 0.01% | 0.02% | 0.01% | 0.01% |
| | T | 0.01% | 0.00% | 0.00% | 0.00% | 0.00% | 0.00% | 0.00% | 0.00% | 0.01% | 0.01% |

| HEK2-1 pNMG-346 | | 2 A | 3 A | 4 A | 5 A | 6 A | 7 A | 8 A | 9 A | 12 A | 14 A |
|---|---|---|---|---|---|---|---|---|---|---|---|
| | A | 99.98% | 99.98% | 99.99% | 99.98% | 99.99% | 99.99% | 99.98% | 99.97% | 99.96% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.00% | 0.01% | 0.01% | 0.01% | 0.01% | 0.02% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-347 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.99% | 99.98% | 99.99% | 99.99% | 99.99% | 99.98% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.00% | 0.01% | 0.02% | 0.01% | 0.00% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

| HEK2-1 pNMG-348 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.99% | 99.99% | 99.99% | 99.99% | 99.99% | 99.99% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.00% | 0.01% | 0.01% | 0.01% | 0.00% | 0.01% | 0.01% | 0.02% | 0.01% | 0.01% |
| | T | 0.00% | 0.00% | 0.00% | 0.00% | 0.00% | 0.00% | 0.00% | 0.00% | 0.01% | 0.01% |

| HEK2-1 pNMG-349 | | 2 A | 3 A | 4 A | 5 A | 6 A | 7 A | 8 A | 9 A | 12 A | 14 A |
|---|---|---|---|---|---|---|---|---|---|---|---|
| | A | 99.99% | 99.98% | 100.00% | 99.98% | 99.99% | 99.98% | 99.98% | 99.98% | 99.97% | 99.98% |
| | C | 0.00% | 0.00% | 0.00% | 0.00% | 0.00% | 0.00% | 0.00% | 0.00% | 0.00% | 0.00% |
| | G | 0.00% | 0.01% | 0.00% | 0.01% | 0.01% | 0.01% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

FIGURE 131

Hek 2-2 site: 5'-GA₂A₃TA₅CTA₈A₉GCA₁₂TA₁₄GA₁₆CTCCAGG-3'

| HEK2-2 pNMG-339 | 2 | 3 | 5 | 8 | 9 | 12 | 14 | 16 |
|---|---|---|---|---|---|---|---|---|
|  | A | A | A | A | A | A | A | A |
| A | 99.63% | 99.44% | 99.98% | 99.54% | 99.65% | 99.97% | 99.97% | 99.97% |
| C | 0.00% | 0.00% | 0.00% | 0.00% | 0.00% | 0.00% | 0.00% | 0.00% |
| G | 0.36% | 0.55% | | 0.45% | 0.35% | 0.01% | 0.01% | 0.01% |
| T | 0.01% | 0.00% | 0.01% | 0.01% | 0.00% | 0.01% | 0.01% | 0.01% |

| HEK2-2 pNMG-340 | 2 | 3 | 5 | 8 | 9 | 12 | 14 | 16 |
|---|---|---|---|---|---|---|---|---|
|  | A | A | A | A | A | A | A | A |
| A | 99.84% | 99.83% | | 99.59% | 99.91% | 99.98% | 99.97% | 99.97% |
| C | 0.00% | 0.00% | 0.00% | 0.00% | 0.00% | 0.00% | 0.00% | 0.00% |
| G | 0.15% | 0.16% | | 0.40% | 0.09% | 0.01% | 0.01% | 0.01% |
| T | 0.00% | 0.01% | 0.02% | 0.00% | 0.00% | 0.01% | 0.01% | 0.01% |

| HEK2-2 pNMG-341 | 2 | 3 | 5 | 8 | 9 | 12 | 14 | 16 |
|---|---|---|---|---|---|---|---|---|
|  | A | A | A | A | A | A | A | A |
| A | 99.58% | 99.29% | | 99.35% | 99.60% | 99.95% | 99.97% | 99.97% |
| C | 0.00% | 0.00% | 0.00% | 0.00% | 0.00% | 0.00% | 0.00% | 0.00% |
| G | 0.42% | 0.70% | | 0.64% | 0.40% | 0.03% | 0.01% | 0.01% |
| T | 0.01% | 0.00% | 0.01% | 0.01% | 0.00% | 0.02% | 0.01% | 0.01% |

| HEK2-2 pNMG-346 | 2 | 3 | 5 | 8 | 9 | 12 | 14 | 16 |
|---|---|---|---|---|---|---|---|---|
|  | A | A | A | A | A | A | A | A |
| A | 99.99% | 99.98% | 99.58% | 99.94% | 99.96% | 99.98% | 99.97% | 99.97% |
| C | 0.00% | 0.00% | 0.00% | 0.00% | 0.00% | 0.00% | 0.00% | 0.00% |
| G | 0.00% | 0.02% | 0.40% | 0.05% | 0.02% | 0.01% | 0.01% | 0.01% |
| T | 0.01% | 0.00% | 0.02% | 0.01% | 0.01% | 0.01% | 0.01% | 0.01% |

| HEK2-2 pNMG-347 | 2 | 3 | 5 | 8 | 9 | 12 | 14 | 16 |
|---|---|---|---|---|---|---|---|---|
|  | A | A | A | A | A | A | A | A |
| A | 99.98% | 99.96% | 94.82% | 99.93% | 99.97% | 99.97% | 99.97% | 99.97% |
| C | 0.00% | 0.00% | 0.00% | 0.00% | 0.00% | 0.00% | 0.00% | 0.00% |
| G | 0.01% | 0.03% | | 0.06% | 0.03% | 0.01% | 0.01% | 0.01% |
| T | 0.01% | 0.00% | 0.01% | 0.00% | 0.00% | 0.02% | 0.01% | 0.01% |

| HEK2-2 pNMG-348 | 2 | 3 | 5 | 8 | 9 | 12 | 14 | 16 |
|---|---|---|---|---|---|---|---|---|
|  | A | A | A | A | A | A | A | A |
| A | 99.98% | 99.93% | 85.18% | 99.91% | 99.98% | 99.97% | 99.97% | 99.97% |
| C | 0.00% | 0.00% | 0.00% | 0.00% | 0.00% | 0.00% | 0.00% | 0.00% |
| G | 0.01% | 0.07% | | 0.08% | 0.02% | 0.01% | 0.01% | 0.01% |
| T | 0.01% | 0.00% | 0.02% | 0.01% | 0.00% | 0.02% | 0.01% | 0.01% |

| HEK2-2 pNMG-349 | 2 | 3 | 5 | 8 | 9 | 12 | 14 | 16 |
|---|---|---|---|---|---|---|---|---|
|  | A | A | A | A | A | A | A | A |
| A | 99.98% | 99.95% | 86.93% | 99.92% | 99.98% | 99.97% | 99.97% | 99.97% |
| C | 0.00% | 0.00% | 0.00% | 0.00% | 0.00% | 0.00% | 0.00% | 0.00% |
| G | 0.01% | 0.05% | | 0.07% | 0.01% | 0.01% | 0.01% | 0.01% |
| T | 0.01% | 0.01% | 0.01% | 0.01% | 0.00% | 0.02% | 0.01% | 0.01% |

FIGURE 132

Hek 2-3 site: 5'-GTA₃A₄A₅CA₇A₈A₉GCA₁₂TA₁₄GA₁₆CTGAGGG-3'

| HEK2-3 pNMG-339 | | 3 A | 4 A | 5 A | 7 A | 8 A | 9 A | 12 A | 14 A | 16 A |
|---|---|---|---|---|---|---|---|---|---|---|
| | A | 99.98% | 99.98% | 99.43% | 99.98% | 99.97% | 99.98% | 99.97% | 99.97% | 99.97% |
| | C | 0.00% | 0.00% | 0.00% | 0.00% | 0.00% | 0.00% | 0.00% | 0.00% | 0.00% |
| | G | 0.01% | 0.02% | 0.56% | 0.01% | 0.01% | 0.01% | 0.01% | 0.01% | 0.01% |
| | T | 0.01% | 0.00% | 0.01% | 0.00% | 0.01% | 0.01% | 0.01% | 0.01% | 0.01% |

| HEK2-3 pNMG-340 | | 3 A | 4 A | 5 A | 7 A | 8 A | 9 A | 12 A | 14 A | 16 A |
|---|---|---|---|---|---|---|---|---|---|---|
| | A | 99.97% | 99.96% | 99.02% | 99.96% | 99.97% | 99.76% | 99.96% | 99.97% | 99.97% |
| | C | 0.00% | 0.00% | 0.00% | 0.00% | 0.00% | 0.19% | 0.00% | 0.00% | 0.00% |
| | G | 0.03% | 0.03% | 0.97% | 0.03% | 0.03% | 0.05% | 0.02% | 0.01% | 0.01% |
| | T | 0.01% | 0.01% | 0.01% | 0.01% | 0.00% | 0.00% | 0.02% | 0.01% | 0.01% |

| HEK2-3 pNMG-341 | | 3 A | 4 A | 5 A | 7 A | 8 A | 9 A | 12 A | 14 A | 16 A |
|---|---|---|---|---|---|---|---|---|---|---|
| | A | 99.97% | 99.95% | 98.58% | 99.97% | 99.97% | 99.79% | 99.96% | 99.97% | 99.97% |
| | C | 0.00% | 0.00% | 0.00% | 0.00% | 0.00% | 0.19% | 0.00% | 0.00% | 0.00% |
| | G | 0.02% | 0.05% | 1.42% | 0.01% | 0.02% | 0.02% | 0.02% | 0.01% | 0.01% |
| | T | 0.01% | 0.01% | 0.01% | 0.01% | 0.01% | 0.00% | 0.02% | 0.01% | 0.01% |

FIGURE 133

Hek 2-4 site: 5'-GGA₃CA₅CA₇A₈A₉GCTTA₁₄GA₁₆CTCCAGG-3'

| HEK2-4 pNMG-339 | | 3 A | 5 A | 7 A | 8 A | 9 A | 14 A | 16 A |
|---|---|---|---|---|---|---|---|---|
| | A | 95.12% | 75.77% | 99.50% | 99.30% | 99.67% | 99.98% | 99.98% |
| | C | 0.00% | 0.01% | 0.00% | 0.00% | 0.00% | 0.00% | 0.00% |
| | G | 4.87% | | 0.49% | 0.64% | 0.32% | 0.01% | 0.01% |
| | T | 0.01% | 0.01% | 0.01% | 0.01% | 0.00% | 0.00% | 0.00% |

| HEK2-4 pNMG-340 | | 3 A | 5 A | 7 A | 8 A | 9 A | 14 A | 16 A |
|---|---|---|---|---|---|---|---|---|
| | A | 97.41% | 71.37% | 99.76% | 99.67% | 99.82% | 99.98% | 99.98% |
| | C | 0.00% | 0.00% | 0.00% | 0.00% | 0.00% | 0.00% | 0.00% |
| | G | 2.58% | | 0.23% | 0.32% | 0.17% | 0.02% | 0.01% |
| | T | 0.01% | 0.01% | 0.01% | 0.00% | 0.00% | 0.00% | 0.00% |

| HEK2-4 pNMG-341 | | 3 A | 5 A | 7 A | 8 A | 9 A | 14 A | 16 A |
|---|---|---|---|---|---|---|---|---|
| | A | 93.73% | | 99.34% | 99.22% | 99.69% | 99.98% | 99.98% |
| | C | 0.00% | 0.02% | 0.00% | 0.00% | 0.00% | 0.00% | 0.00% |
| | G | 6.26% | | 0.65% | 0.78% | 0.30% | 0.02% | 0.01% |
| | T | 0.01% | 0.01% | 0.01% | 0.00% | 0.00% | 0.00% | 0.00% |

FIGURE 134

Hek2-6 similar: 5'-GA$_2$A$_3$GA$_5$CCA$_8$A$_9$GGATAGACTGCTGG-3'

| HEK2-6 pNMG-339 | 2 A | 3 A | 5 A | 8 A | 9 A | 12 A | 14 A |
|---|---|---|---|---|---|---|---|
| A | 99.95% | 99.85% | 95.56% | 99.74% | 99.90% | 99.97% | 99.98% |
| C | 0.00% | 0.01% | 0.00% | 0.00% | 0.00% | 0.00% | 0.00% |
| G | 0.04% | 0.12% | 4.43% | 0.24% | 0.08% | 0.01% | 0.01% |
| T | 0.01% | 0.01% | 0.01% | 0.02% | 0.01% | 0.02% | 0.00% |

| HEK2-6 pNMG-340 | 2 A | 3 A | 5 A | 8 A | 9 A | 12 A | 14 A |
|---|---|---|---|---|---|---|---|
| A | 99.97% | 99.97% | 95.74% | 99.81% | 99.90% | 99.98% | 99.98% |
| C | 0.00% | 0.00% | 0.00% | 0.01% | 0.00% | 0.00% | 0.00% |
| G | 0.02% | 0.02% | 4.25% | 0.17% | 0.09% | 0.01% | 0.01% |
| T | 0.01% | 0.00% | 0.02% | 0.01% | 0.01% | 0.01% | 0.00% |

| HEK2-6 pNMG-341 | 2 A | 3 A | 5 A | 8 A | 9 A | 12 A | 14 A |
|---|---|---|---|---|---|---|---|
| A | 99.95% | 99.85% | 95.56% | 99.74% | 99.90% | 99.97% | 99.98% |
| C | 0.00% | 0.01% | 0.00% | 0.00% | 0.00% | 0.00% | 0.00% |
| G | 0.04% | 0.12% | 4.43% | 0.24% | 0.08% | 0.01% | 0.01% |
| T | 0.01% | 0.01% | 0.01% | 0.02% | 0.01% | 0.02% | 0.00% |

| HEK2-6 pNMG-346 | 2 A | 3 A | 5 A | 8 A | 9 A | 12 A | 14 A |
|---|---|---|---|---|---|---|---|
| A | 99.98% | 99.99% | 99.76% | 99.97% | 99.98% | 99.98% | 99.98% |
| C | 0.00% | 0.00% | 0.00% | 0.00% | 0.00% | 0.00% | 0.00% |
| G | 0.01% | 0.00% | 0.23% | 0.02% | 0.01% | 0.00% | 0.01% |
| T | 0.01% | 0.01% | 0.01% | 0.01% | 0.01% | 0.01% | 0.00% |

| HEK2-6 pNMG-347 | 2 A | 3 A | 5 A | 8 A | 9 A | 12 A | 14 A |
|---|---|---|---|---|---|---|---|
| A | 99.95% | 99.97% | 99.62% | 99.97% | 99.95% | 99.97% | 99.98% |
| C | 0.00% | 0.00% | 0.00% | 0.00% | 0.00% | 0.00% | 0.00% |
| G | 0.03% | 0.01% | 0.35% | 0.02% | 0.03% | 0.01% | 0.01% |
| T | 0.02% | 0.01% | 0.02% | 0.00% | 0.02% | 0.02% | 0.00% |

| HEK2-6 pNMG-348 | 2 A | 3 A | 5 A | 8 A | 9 A | 12 A | 14 A |
|---|---|---|---|---|---|---|---|
| A | 99.97% | 99.98% | 99.68% | 99.97% | 99.97% | 99.98% | 99.98% |
| C | 0.00% | 0.00% | 0.00% | 0.00% | 0.00% | 0.00% | 0.00% |
| G | 0.02% | 0.02% | 0.30% | 0.01% | 0.01% | 0.00% | 0.01% |
| T | 0.01% | 0.01% | 0.02% | 0.01% | 0.02% | 0.02% | 0.01% |

| HEK2-6 pNMG-349 | 2 A | 3 A | 5 A | 8 A | 9 A | 12 A | 14 A |
|---|---|---|---|---|---|---|---|
| A | 99.97% | 99.97% | 99.74% | 99.97% | 99.97% | 99.97% | 99.98% |
| C | 0.00% | 0.00% | 0.00% | 0.01% | 0.00% | 0.00% | 0.00% |
| G | 0.02% | 0.01% | 0.25% | 0.01% | 0.02% | 0.01% | 0.01% |
| T | 0.01% | 0.01% | 0.01% | 0.01% | 0.00% | 0.01% | 0.00% |

FIGURE 135

Hek2-9 site: 5'-GA$_2$A$_3$A$_4$A$_5$CA$_7$A$_8$A$_9$A$_{10}$CA$_{12}$TA$_{14}$GAGTGCTGG-3'

| HEK2-9 pNMG-339 | | 2 A | 3 A | 4 A | 5 A | 7 A | 8 A | 9 A | 10 A | 12 A | 14 A |
|---|---|---|---|---|---|---|---|---|---|---|---|
| | A | 99.96% | 99.90% | 99.69% | 96.22% | 99.74% | 99.76% | 99.54% | 98.67% | 99.97% | 99.97% |
| | C | 0.00% | 0.00% | 0.03% | 0.00% | 0.01% | 0.00% | 0.00% | 0.00% | 0.00% | 0.01% |
| | G | 0.04% | 0.10% | 0.28% | 3.68% | 0.24% | 0.24% | 0.46% | 1.32% | 0.01% | 0.02% |
| | T | 0.00% | 0.00% | 0.00% | 0.00% | 0.01% | 0.00% | 0.00% | 0.00% | 0.01% | 0.01% |

| HEK2-9 pNMG-340 | | 2 A | 3 A | 4 A | 5 A | 7 A | 8 A | 9 A | 10 A | 12 A | 14 A |
|---|---|---|---|---|---|---|---|---|---|---|---|
| | A | 99.96% | 99.97% | 99.80% | 99.26% | 99.94% | 99.92% | 99.76% | 99.33% | 99.98% | 99.97% |
| | C | 0.00% | 0.00% | 0.03% | 0.01% | 0.00% | 0.00% | 0.00% | 0.01% | 0.00% | 0.01% |
| | G | 0.03% | 0.03% | 0.17% | 0.73% | 0.05% | 0.07% | 0.24% | 0.66% | 0.01% | 0.02% |
| | T | 0.01% | 0.00% | 0.00% | 0.00% | 0.00% | 0.00% | 0.00% | 0.00% | 0.01% | 0.01% |

| HEK2-9 pNMG-341 | | 2 A | 3 A | 4 A | 5 A | 7 A | 8 A | 9 A | 10 A | 12 A | 14 A |
|---|---|---|---|---|---|---|---|---|---|---|---|
| | A | 99.90% | 99.83% | 99.47% | 99.33% | 99.62% | 99.65% | 99.33% | 98.64% | 99.92% | 99.97% |
| | C | 0.00% | 0.00% | 0.02% | 0.01% | 0.00% | 0.00% | 0.00% | 0.00% | 0.00% | 0.01% |
| | G | 0.10% | 0.17% | 0.51% | 0.66% | 0.37% | 0.35% | 0.66% | 1.35% | 0.06% | 0.02% |
| | T | 0.01% | 0.00% | 0.00% | 0.00% | 0.00% | 0.00% | 0.00% | 0.01% | 0.02% | 0.01% |

| HEK2-9 pNMG-346 | | 2 A | 3 A | 4 A | 5 A | 7 A | 8 A | 9 A | 10 A | 12 A | 14 A |
|---|---|---|---|---|---|---|---|---|---|---|---|
| | A | 99.98% | 99.98% | 99.96% | 99.93% | 99.99% | 99.98% | 99.99% | 99.95% | 99.98% | 99.98% |
| | C | 0.00% | 0.00% | 0.03% | 0.01% | 0.00% | 0.00% | 0.00% | 0.00% | 0.00% | 0.00% |
| | G | 0.01% | 0.01% | 0.01% | 0.06% | 0.01% | 0.02% | 0.01% | 0.04% | 0.01% | 0.01% |
| | T | 0.01% | 0.01% | 0.00% | 0.00% | 0.00% | 0.00% | 0.00% | 0.01% | 0.01% | 0.01% |

| HEK2-9 pNMG-347 | | 2 A | 3 A | 4 A | 5 A | 7 A | 8 A | 9 A | 10 A | 12 A | 14 A |
|---|---|---|---|---|---|---|---|---|---|---|---|
| | A | 100.00% | 99.98% | 99.94% | 99.76% | 99.98% | 99.97% | 99.97% | 99.93% | 99.98% | 99.97% |
| | C | 0.00% | 0.00% | 0.04% | 0.00% | 0.00% | 0.00% | 0.00% | 0.00% | 0.00% | 0.01% |
| | G | 0.00% | 0.01% | 0.02% | 0.23% | 0.01% | 0.02% | 0.03% | 0.06% | 0.01% | 0.02% |
| | T | 0.00% | 0.01% | 0.00% | 0.00% | 0.01% | 0.01% | 0.00% | 0.01% | 0.01% | 0.01% |

| HEK2-9 pNMG-348 | | 2 A | 3 A | 4 A | 5 A | 7 A | 8 A | 9 A | 10 A | 12 A | 14 A |
|---|---|---|---|---|---|---|---|---|---|---|---|
| | A | 99.97% | 99.96% | 99.96% | 99.86% | 99.99% | 99.98% | 99.98% | 99.96% | 99.98% | 99.94% |
| | C | 0.00% | 0.00% | 0.02% | 0.00% | 0.00% | 0.00% | 0.00% | 0.00% | 0.00% | 0.01% |
| | G | 0.01% | 0.02% | 0.02% | 0.14% | 0.01% | 0.01% | 0.01% | 0.03% | 0.00% | 0.04% |
| | T | 0.01% | 0.01% | 0.00% | 0.00% | 0.00% | 0.00% | 0.00% | 0.01% | 0.01% | 0.01% |

| HEK2-9 pNMG-349 | | 2 A | 3 A | 4 A | 5 A | 7 A | 8 A | 9 A | 10 A | 12 A | 14 A |
|---|---|---|---|---|---|---|---|---|---|---|---|
| | A | 99.98% | 99.98% | 99.62% | 99.66% | 99.97% | 99.98% | 99.98% | 99.63% | 99.98% | 99.96% |
| | C | 0.00% | 0.00% | 0.35% | 0.00% | 0.00% | 0.00% | 0.00% | 0.00% | 0.00% | 0.01% |
| | G | 0.01% | 0.01% | 0.03% | 0.34% | 0.02% | 0.01% | 0.01% | 0.37% | 0.01% | 0.03% |
| | T | 0.01% | 0.01% | 0.00% | 0.00% | 0.00% | 0.00% | 0.00% | 0.01% | 0.01% | 0.00% |

FIGURE 136

Hek2-10 site: 5'-GA₂A₃CA₅TA₇A₈A₉GA₁₁A₁₂TA₁₄GA₁₆ATGATGG-3'

| HEK2-10 pNMG-339 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.71% | 98.28% | 98.99% | 98.35% | 98.78% | 99.52% | 99.46% | 99.98% | 99.98% | 99.98% |
| C | 0.00% | 0.00% | 0.00% | 0.00% | 0.00% | 0.00% | 0.01% | 0.00% | 0.00% | 0.00% |
| G | 0.28% | 1.71% | 1.00% | 1.64% | 1.21% | 0.47% | 0.52% | 0.02% | 0.01% | 0.01% |
| T | 0.01% | 0.01% | 0.01% | 0.01% | 0.01% | 0.00% | 0.01% | 0.01% | 0.01% | 0.01% |

| HEK2-10 pNMG-340 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.87% | 99.47% | 93.87% | 99.11% | 99.59% | 99.79% | 99.75% | 99.98% | 99.97% | 99.98% |
| C | 0.00% | 0.00% | 0.00% | 0.00% | 0.00% | 0.00% | 0.01% | 0.00% | 0.00% | 0.00% |
| G | 0.12% | 0.52% | 6.12% | 0.89% | 0.40% | 0.20% | 0.22% | 0.02% | 0.02% | 0.01% |
| T | 0.01% | 0.01% | 0.01% | 0.00% | 0.01% | 0.01% | 0.01% | 0.01% | 0.01% | 0.01% |

| HEK2-10 pNMG-341 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.87% | 97.98% | 94.95% | 97.09% | 98.45% | 99.40% | 99.47% | 99.97% | 99.98% | 99.98% |
| C | 0.00% | 0.00% | 0.00% | 0.00% | 0.01% | 0.00% | 0.01% | 0.00% | 0.00% | 0.00% |
| G | 0.39% | 2.00% | 5.03% | 2.90% | 1.53% | 0.59% | 0.50% | 0.02% | 0.01% | 0.01% |
| T | 0.01% | 0.01% | 0.01% | 0.01% | 0.01% | 0.00% | 0.01% | 0.00% | 0.01% | 0.01% |

| HEK2-10 pNMG-346 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.96% | 99.96% | 99.67% | 99.71% | 99.96% | 99.95% | 99.97% | 99.99% | 99.98% | 99.98% |
| C | 0.00% | 0.00% | 0.00% | 0.00% | 0.00% | 0.00% | 0.02% | 0.00% | 0.00% | 0.00% |
| G | 0.02% | 0.03% | 0.32% | 0.29% | 0.03% | 0.04% | 0.01% | 0.01% | 0.01% | 0.01% |
| T | 0.01% | 0.01% | 0.01% | 0.00% | 0.01% | 0.01% | 0.01% | 0.01% | 0.01% | 0.01% |

| HEK2-10 pNMG-347 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.98% | 99.93% | 99.06% | 99.56% | 99.93% | 99.95% | 99.97% | 99.99% | 99.97% | 99.98% |
| C | 0.00% | 0.00% | 0.00% | 0.00% | 0.00% | 0.00% | 0.02% | 0.00% | 0.00% | 0.00% |
| G | 0.01% | 0.06% | 0.93% | 0.43% | 0.06% | 0.04% | 0.01% | 0.01% | 0.02% | 0.01% |
| T | 0.01% | 0.01% | 0.01% | 0.00% | 0.01% | 0.01% | 0.01% | 0.01% | 0.01% | 0.01% |

| HEK2-10 pNMG-348 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.96% | 99.94% | 98.39% | 99.50% | 99.92% | 99.97% | 99.97% | 99.99% | 99.98% | 99.98% |
| C | 0.00% | 0.00% | 0.00% | 0.00% | 0.00% | 0.00% | 0.02% | 0.00% | 0.00% | 0.00% |
| G | 0.03% | 0.05% | 1.59% | 0.49% | 0.08% | 0.02% | 0.01% | 0.01% | 0.01% | 0.01% |
| T | 0.01% | 0.01% | 0.01% | 0.01% | 0.00% | 0.00% | 0.01% | 0.01% | 0.01% | 0.01% |

| HEK2-10 pNMG-349 | 2<br>A | 3<br>A | 5<br>A | 7<br>A | 8<br>A | 9<br>A | 11<br>A | 12<br>A | 14<br>A | 16<br>A |
|---|---|---|---|---|---|---|---|---|---|---|
| A | 99.98% | 99.94% | 98.75% | 99.54% | 99.93% | 99.96% | 99.95% | 99.98% | 99.98% | 99.98% |
| C | 0.00% | 0.00% | 0.00% | 0.00% | 0.00% | 0.01% | 0.03% | 0.00% | 0.00% | 0.00% |
| G | 0.01% | 0.04% | 1.24% | 0.46% | 0.06% | 0.02% | 0.01% | 0.01% | 0.01% | 0.01% |
| T | 0.01% | 0.01% | 0.01% | 0.00% | 0.01% | 0.01% | 0.01% | 0.00% | 0.01% | 0.01% |

FIGURE 137

Hek3- 5'-GGCCCA GA CTGA GCA CGTGATGG-3'
              6   8    12  15

| HEK3 pNMG-339 | 6 A | 8 A | 12 A | 15 A |
|---|---|---|---|---|
| A | | | | |
| C | 0.00% | 0.00% | 0.00% | 0.00% |
| G | 2.02% | | 0.04% | 0.01% |
| T | 0.01% | 0.01% | 0.00% | 0.01% |

| HEK3 pNMG-346 | 6 A | 8 A | 12 A | 15 A |
|---|---|---|---|---|
| A | | | | |
| C | 0.00% | 0.00% | 0.00% | 0.00% |
| G | 0.12% | 0.23% | 0.05% | 0.01% |
| T | 0.01% | 0.01% | 0.00% | 0.01% |

| HEK3 pNMG-340 | 6 A | 8 A | 12 A | 15 A |
|---|---|---|---|---|
| A | | | | |
| C | 0.00% | 0.00% | 0.00% | 0.00% |
| G | 1.03% | 3.43% | 0.04% | 0.01% |
| T | 0.01% | 0.00% | 0.01% | 0.01% |

| HEK3 pNMG-347 | 6 A | 8 A | 12 A | 15 A |
|---|---|---|---|---|
| A | | | | |
| C | 0.00% | 0.00% | 0.00% | 0.00% |
| G | 0.26% | 0.56% | 0.03% | 0.01% |
| T | 0.01% | 0.01% | 0.01% | 0.01% |

| HEK3 pNMG-341 | 6 A | 8 A | 12 A | 15 A |
|---|---|---|---|---|
| A | | | | |
| C | 0.00% | 0.00% | 0.00% | 0.00% |
| G | 2.25% | | 0.03% | 0.01% |
| T | 0.01% | 0.01% | 0.01% | 0.01% |

| HEK3 pNMG-348 | 6 A | 8 A | 12 A | 15 A |
|---|---|---|---|---|
| A | | | | |
| C | 0.00% | 0.00% | 0.00% | 0.00% |
| G | 0.22% | 0.37% | 0.04% | 0.00% |
| T | 0.02% | 0.01% | 0.00% | 0.01% |

| HEK3 pNMG-349 | 6 A | 8 A | 12 A | 15 A |
|---|---|---|---|---|
| A | | | | |
| C | 0.00% | 0.00% | 0.00% | 0.00% |
| G | 0.14% | 0.53% | 0.02% | 0.00% |
| T | 0.01% | 0.01% | 0.00% | 0.01% |

FIGURE 138

RNF2- 5'-GTCA TCTTA GTCA TTA CCTGAGG-3'

| RNF2 pNMG-339 | 4 A | 9 A | 13 A | 16 A |
|---|---|---|---|---|
| A | 99.21% | 99.39% | 99.98% | 99.97% |
| C | 0.00% | 0.02% | 0.00% | 0.00% |
| G | 0.78% | 0.58% | 0.01% | 0.02% |
| T | 0.01% | 0.01% | 0.01% | 0.01% |

| RNF2 pNMG-346 | 4 A | 9 A | 13 A | 16 A |
|---|---|---|---|---|
| A | 99.97% | 99.93% | 99.98% | 99.98% |
| C | 0.00% | 0.02% | 0.00% | 0.00% |
| G | 0.02% | 0.04% | 0.01% | 0.01% |
| T | 0.01% | 0.01% | 0.01% | 0.01% |

| RNF2 pNMG-340 | 4 A | 9 A | 13 A | 16 A |
|---|---|---|---|---|
| A | 99.75% | 99.69% | 99.98% | 99.98% |
| C | 0.00% | 0.01% | 0.00% | 0.00% |
| G | 0.24% | 0.29% | 0.01% | 0.01% |
| T | 0.01% | 0.01% | 0.01% | 0.01% |

| RNF2 pNMG-347 | 4 A | 9 A | 13 A | 16 A |
|---|---|---|---|---|
| A | 99.95% | 99.90% | 99.98% | 99.98% |
| C | 0.00% | 0.01% | 0.00% | 0.00% |
| G | 0.04% | 0.08% | 0.01% | 0.01% |
| T | 0.01% | 0.01% | 0.01% | 0.01% |

| RNF2 pNMG-341 | 4 A | 9 A | 13 A | 16 A |
|---|---|---|---|---|
| A | 98.86% | 98.94% | 99.97% | 99.97% |
| C | 0.00% | 0.02% | 0.00% | 0.00% |
| G | 1.12% | 1.03% | 0.01% | 0.02% |
| T | 0.02% | 0.01% | 0.01% | 0.01% |

| RNF2 pNMG-348 | 4 A | 9 A | 13 A | 16 A |
|---|---|---|---|---|
| A | 99.93% | 99.96% | 99.97% | 99.97% |
| C | 0.00% | 0.01% | 0.00% | 0.00% |
| G | 0.06% | 0.02% | 0.01% | 0.02% |
| T | 0.01% | 0.00% | 0.01% | 0.01% |

| RNF2 pNMG-349 | 4 A | 9 A | 13 A | 16 A |
|---|---|---|---|---|
| A | 99.93% | 99.95% | 99.98% | 99.98% |
| C | 0.00% | 0.02% | 0.00% | 0.00% |
| G | 0.05% | 0.02% | 0.01% | 0.01% |
| T | 0.01% | 0.00% | 0.01% | 0.01% |

FIGURE 139

FANCF- 5'-GGA A TCCCTTCTGCA GCA CCTGG-3'
            3 4           15    18

| FancF pNMG-339 | | 3 A | 4 A | 15 A | 18 A |
|---|---|---|---|---|---|
| | A | 99.72% | 98.46% | 99.98% | 99.98% |
| | C | 0.01% | 0.01% | 0.00% | 0.00% |
| | G | 0.26% | 1.52% | 0.02% | 0.01% |
| | T | 0.01% | 0.01% | 0.00% | 0.01% |

| FancF pNMG-346 | | 3 A | 4 A | 15 A | 18 A |
|---|---|---|---|---|---|
| | A | 99.97% | 99.85% | 99.98% | 99.98% |
| | C | 0.01% | 0.01% | 0.00% | 0.00% |
| | G | 0.01% | 0.13% | 0.02% | 0.01% |
| | T | 0.01% | 0.01% | 0.00% | 0.01% |

| FancF pNMG-340 | | 3 A | 4 A | 15 A | 18 A |
|---|---|---|---|---|---|
| | A | 99.94% | 99.50% | 99.98% | 99.98% |
| | C | 0.01% | 0.01% | 0.00% | 0.00% |
| | G | 0.04% | 0.48% | 0.01% | 0.00% |
| | T | 0.01% | 0.00% | 0.00% | 0.01% |

| FancF pNMG-347 | | 3 A | 4 A | 15 A | 18 A |
|---|---|---|---|---|---|
| | A | 99.95% | 99.65% | 99.98% | 99.98% |
| | C | 0.00% | 0.00% | 0.00% | 0.00% |
| | G | 0.04% | 0.34% | 0.02% | 0.00% |
| | T | 0.01% | 0.00% | 0.01% | 0.01% |

| FancF pNMG-341 | | 3 A | 4 A | 15 A | 18 A |
|---|---|---|---|---|---|
| | A | 99.69% | 98.46% | 99.98% | 99.98% |
| | C | 0.01% | 0.01% | 0.00% | 0.00% |
| | G | 0.29% | 1.52% | 0.02% | 0.01% |
| | T | 0.01% | 0.00% | 0.00% | 0.01% |

| FancF pNMG-348 | | 3 A | 4 A | 15 A | 18 A |
|---|---|---|---|---|---|
| | A | 99.94% | 99.09% | 99.98% | 99.98% |
| | C | 0.00% | 0.00% | 0.00% | 0.00% |
| | G | 0.05% | 0.90% | 0.01% | 0.01% |
| | T | 0.01% | 0.01% | 0.00% | 0.01% |

| FancF pNMG-349 | | 3 A | 4 A | 15 A | 18 A |
|---|---|---|---|---|---|
| | A | 99.93% | 99.13% | 99.98% | 99.98% |
| | C | 0.01% | 0.01% | 0.00% | 0.00% |
| | G | 0.05% | 0.85% | 0.01% | 0.01% |
| | T | 0.01% | 0.01% | 0.00% | 0.01% |

| construct | HEK2 | Site 2 | site 4 | site 8 | site 9 |
|---|---|---|---|---|---|
| 107 | 0.00 | 0.01 | 0.01 | 0.06 | 0.06 |
| 108 | 0.53 | 0.18 | 0.02 | 0.02 | 0.10 |
| 109 | 0.01 | 0.03 | 0.04 | 0.05 | 0.00 |
| 142 | 0.05 | 0.01 | 0.03 | 0.13 | 0.10 |
| 144 | 0.00 | 0.07 | 0.01 | 0.02 | 0.02 |
| 177 | 0.12 | 0.12 | 0.08 | 0.03 | 0.04 |
| 335 | 0.04 | 0.03 | 0.04 | 0.00 | 0.04 |
| 370 | 0.32 | 0.09 | 0.09 | 0.01 | 0.03 |
| 371 | 0.36 | 0.17 | 0.23 | 0.09 | 0.03 |
| 402 | 0.26 | 0.16 | 0.33 | 0.00 | 0.01 |
| 404 | 0.13 | 0.17 | 0.12 | 0.11 | 0.02 |
| 476 | 0.01 | 0.14 | 0.05 | 0.00 | 0.10 |
| 477 | 0.05 | 0.10 | 0.07 | 0.09 | 0.06 |
| 478 | 0.03 | 0.20 | 0.07 | 0.03 | 0.02 |
| 482 | 0.03 | 0.16 | 0.02 | 0.09 | 0.16 |
| 494 | 0.00 | 0.11 | 0.11 | 0.08 | 0.01 |
| 492 | 0.43 | | 0.07 | 0.02 | 0.03 |
| 497 | 0.05 | | 0.05 | 0.07 | 0.12 |
| 498 | 0.13 | | 0.08 | 0.05 | 0.14 |
| 500 | 0.01 | | 0.03 | 0.05 | 0.01 |
| BE3 | 1.05 | | 1.69 | 0.13 | 0.20 |
| BE3B | 6.34 | | 6.90 | 0.13 | 0.18 |
| Cas9 | 28.92 | | 31.98 | 39.19 | 17.16 |

Figure 143

| sgRNA | site | 462 | 476 | 476+274 | 476+275 | 477 | 477+274 | 477+275 | 285b | 285b+274 | 285b+275 | 277 |
|---|---|---|---|---|---|---|---|---|---|---|---|---|
| 299 | GAACA_CAAAGCATAGACTGC | 1.9 | 67.5 | 59.6 | 51.2 | 72.9 | 63.9 | 60.1 | 30.8 | 31.2 | 27.0 | 45.2 |
| 301 | GGAA_CACAAAGCATAGACTG | 0.3 | 29.5 | 23.3 | 16.5 | 37.1 | 24.6 | 32.0 | 16.9 | 14.5 | 12.5 | 19.9 |
| 301 | GGAACA_CAAAGCATAGACTG | 2.8 | 53.0 | 38.3 | 33.7 | 61.0 | 44.3 | 47.6 | 19.7 | 17.1 | 15.4 | 24.4 |
| 502 | GGGGA_CGGCGCTGGCTTCCCG | 0.0 | 4.1 | 4.7 | 3.6 | 3.5 | 4.1 | 5.1 | 2.7 | 2.0 | 1.3 | 1.0 |
| 505 | GGGA_AAGACCCAGCATCCGT | 0.0 | 0.1 | 0.2 | 0.2 | 0.2 | 0.1 | 0.8 | 0.6 | 0.0 | 0.0 | 0.0 |
| 505 | GGGAAA_AGACCCAGCATCCGT | 0.0 | 0.6 | 0.6 | 0.1 | 1.1 | 0.2 | 0.2 | 1.2 | 0.1 | 0.1 | 0.5 |
| 505 | GGGAAA_GACCCAGCATCCGT | 0.0 | 1.4 | 0.1 | 0.3 | 0.3 | 1.2 | 0.8 | 0.6 | 0.6 | 0.4 | 0.0 |
| 505 | GGGAAAGA_CCCAGCATCCGT | 0.7 | 3.1 | 1.3 | 1.2 | 3.2 | 1.4 | 1.9 | 0.5 | 0.1 | 0.2 | 0.6 |
| 507 | GAAA_CTGGTCCCGTTTACAG | 0.0 | 0.5 | 0.2 | 0.1 | 0.5 | 0.5 | 0.3 | | 0.5 | 0.2 | 0.3 |
| 509 | GCCTAGGCAGTGGGGGTGCA | 0.0 | | 2.0 | 2.0 | | 1.7 | 2.0 | 1.3 | 0.1 | 0.7 | 0.7 |

Figure 144

| Site | Protospacer and PAM sequence | 371 | 402 | 404 | 410 | 476 | 477 | 478 | 479 | 475 |
|---|---|---|---|---|---|---|---|---|---|---|
| CAC (Hek2) | GAACACAAAGCATAGACTGCTGG | 45.4 | 48.1 | 41.0 | 46.2 | 51.9 | 39.6 | 45.9 | 35.2 | |
| AAA | GAAAAAAAGCAGAGACTGCTGG | 0.1 | 0.1 | 0.0 | 0.1 | 0.2 | 0.3 | 0.2 | 0.0 | |
| TAC | GAATACTAAGCATAGACTCCAGG | 37.7 | 39.9 | 38.5 | 43.4 | 45.1 | 41.4 | 38.3 | 25.7 | |
| AAC | GTAAACAAAGCATAGACTGAGGG | 17.8 | 21.8 | 16.9 | 19.5 | 14.1 | 14.8 | 14.2 | 9.7 | |
| GAC | GAAGACCAAGGATAGACTGCTGG | 7.7 | 6.5 | 4.7 | 11.4 | 7.6 | 9.3 | 7.4 | 2.3 | |
| CAT | GAACATAAAGAATAGAATGATGG | 16.4 | 20.8 | 16.0 | 21.7 | 16.7 | 22.3 | 21.3 | 12.9 | |
| CAG | GGACAGGCAGCATAGACTGTGGG | 9.6 | 16.9 | 9.4 | 13.7 | 24.9 | 22.7 | 29.0 | 26.7 | |
| GAA | GTAGAAAAGTATAGACTGCAGG | 2.9 | 2.8 | 2.5 | 4.8 | 8.7 | 6.4 | 6.0 | 3.7 | |
| GAG | GGAGAGAGAGCATAGACTGCTGG | 7.6 | 10.6 | 5.6 | 10.4 | 16.5 | 26.0 | 14.1 | 9.2 | 11.1 |
| GAT | GAAGATAGAGACCATAGACTGCTGG | 2.6 | 4.1 | 2.2 | 6.1 | 7.1 | 7.3 | 5.6 | 3.2 | |
| TAA | GGCTAAGCACCATAGACTGTGGG | 2.3 | 3.7 | 1.8 | 2.8 | 4.2 | 5.6 | 4.1 | 2.2 | 0.5 |
| TAG | GTCTTAGAAAGCTTAGACTGCTGG | 10.1 | 14.9 | 8.1 | 9.1 | 24.3 | 28.3 | 20.3 | 13.6 | 9.8 |
| TAT | GAGTATGAGGCATAGACTGCAGG | 21.0 | 38.1 | 18.3 | 32.3 | 37.0 | 43.3 | 40.1 | 28.4 | 31.4 |
| AAG | GTCAAGAAAGCAGAGACTGCCGG | 6.1 | 6.5 | 5.6 | 10.7 | 11.9 | 12.6 | 9.8 | 7.8 | 11.7 |
| AAT | GGGAATAAATCATAGAATCCTGG | 5.9 | 11.2 | 6.4 | 16.7 | 20.1 | 15.3 | 16.0 | 11.1 | 18.7 |
| CAA | GAGCAAGAGAATAGACTGTAGG | 2.5 | 5.4 | 2.8 | 3.2 | 7.4 | 13.3 | 6.9 | 6.2 | 0.3 |

| Site | Protospacer and PAM sequence | Cas9 (indel %) | 1st rnd A106V D108N H133Y D147Y E155F = 3rd round | 3rd round + N375 K161T | 3rd round + D24G Q71R H96L K160E | 3rd round + H36L G87V S146T | 3rd round + Q71L L137M A143E | 3rd round + E26G Q152L | 3rd round + A91T F104I | 3rd round + N72D G125A | 3rd round + P48S S97C | | 3rd round + A142N |
|---|---|---|---|---|---|---|---|---|---|---|---|---|---|
| HEK2 | GAACACAAAGCATAGACTGCTGG | 76.9 | 78.3 | 77.4 | 43.6 | 2.9 | 62.6 | 16.3 | 10.7 | 71.4 | 66.5 | 51.6 | 61.2 |
| HEK2-1 | GAAAAAAAGCAGAGACTGCTGG | 17.9 | 0.6 | 0.4 | 1.2 | 0.0 | 0.2 | 0.0 | 0.1 | 0.2 | 0.3 | 0.4 | 0.1 |
| HEK2-2 | GAATACTAAGCATAGACTCCAGG | 33.0 | 57.0 | 56.3 | 16.2 | 1.1 | 34.7 | 6.9 | 4.0 | 49.2 | 39.7 | 31.3 | 27.3 |
| HEK2-3 | GTAAACAAAGCATAGACTGAGGG | 43.0 | 29.5 | 31.1 | 14.8 | 0.4 | 8.7 | 1.5 | 4.2 | 17.3 | 14.1 | 13.3 | 6.0 |
| HEK2-6 | GAAGACCAAGGATAGACTGCTGG | 23.5 | 8.4 | | 2.6 | 0.2 | 2.1 | 1.0 | 0.7 | 3.0 | 2.8 | 5.1 | |
| HEK2-10 | GAACATAAAGAATAGAATGATGG | 20.9 | 21.0 | 16.9 | 7.9 | 0.4 | 6.7 | 2.0 | 1.5 | 8.4 | 16.7 | 8.2 | 4.9 |

| sgRNA | site | ABE2 | ABE3 | ABE4 | ABE5-1 | ABE5-2 | ABE5-3 |
|---|---|---|---|---|---|---|---|
| 299 | GAACA CAAAGCATAGACTGC | 13.6 | 58.5 | 54.4 | 77.6 | 69.5 | 57.3 |
| 502 | GGGGA CGCGCTGGCTTCCCG | 0.9 | 5.6 | 3.0 | 5.8 | 3.0 | 3.3 |
| 504 | GCCA CTTCTAAGCCCTTGAT | 1.0 | 7.4 | 4.2 | 7.6 | 5.1 | 5.4 |
| 505 | GGGA AAGACCCAGCATCCGT | 0.1 | 0.2 | 0.7 | 0.3 | 0.1 | 0.3 |
| 505 | GGGAAA AGACCCAGCATCCGT | 0.1 | 0.4 | 0.5 | 0.5 | 0.2 | 1.0 |
| 505 | GGGAAA GACCCAGCATCCGT | 0.3 | 0.6 | 0.4 | 0.2 | 0.2 | 0.5 |
| 505 | GGGAAAGA CCCAGCATCCGT | 0.6 | 1.5 | 1.5 | 3.0 | 1.3 | 3.6 |
| 507 | GAAA CTGGTCCCGTTTACAG | 0.1 | 0.6 | 0.3 | 0.9 | 0.4 | 0.6 |
| 508 | GATGA GATAATGATGAGTCA | 1.7 | 11.5 | 0.4 | 15.6 | 8.8 | 6.1 |
| 508 | GATGAGA TAATGATGAGTCA | 1.4 | 5.1 | 0.1 | 6.0 | 3.5 | 4.7 |
| 509 | GCCTA GGCAGTGGGGGTGCA | 0.2 | 3.1 | 0.6 | 5.9 | 2.3 | 1.3 |

| genetic locus | sequence | position of target A | target sequence |
|---|---|---|---|
| pNMG-469 | TAT | 5 | GAGTATGAGGCATAGACTGC |
| pNMG-470 | AAG | 5 | GTCAAGAAAGCAGAGACTGC |
| pNMG-472 | CAA | 5 | GGGAATAAATCATAGAATCC |
| pNMG-508 | GAG | 5 | GATGAGATAATGATGAGTCA |
| pNMG-536 | GAC | 7 | GGATTGACCCAGGCCAGGGC |
| pNMG-299 | CAC | 5 | GAACACAAAGCATAGACTGC |

Correction of: 5'-TTCATTA(7)ACTGTGGCCGGCT-3'
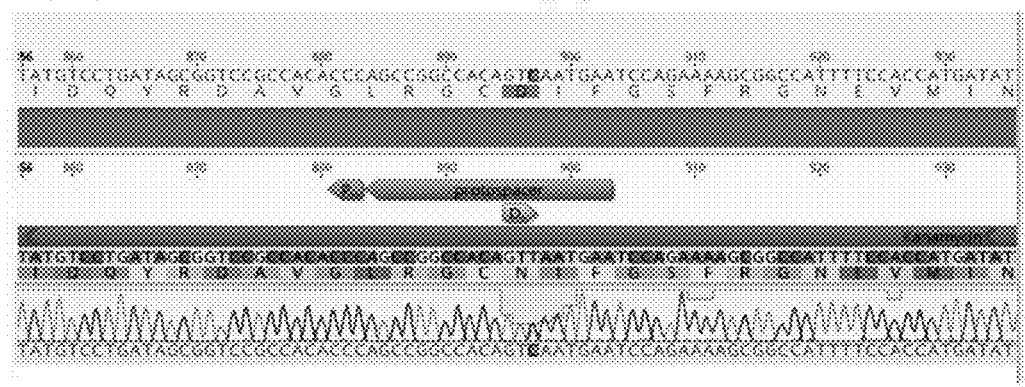
Correction of: 5'-ATCTTA(6)TTCGATCATGCGAA-3'
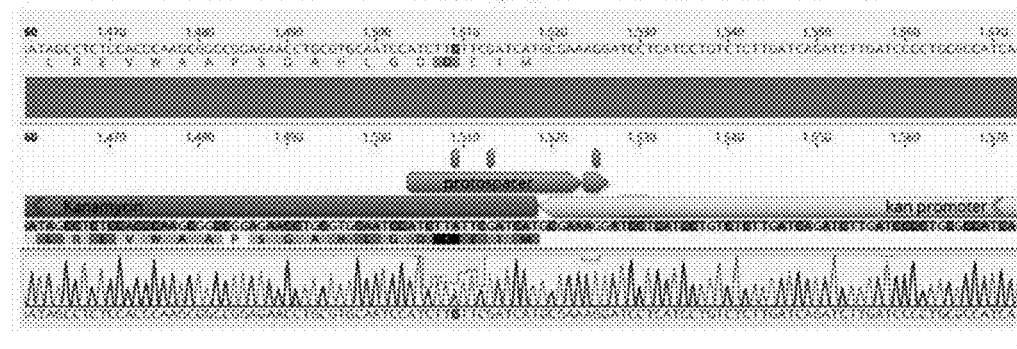
Figure 163

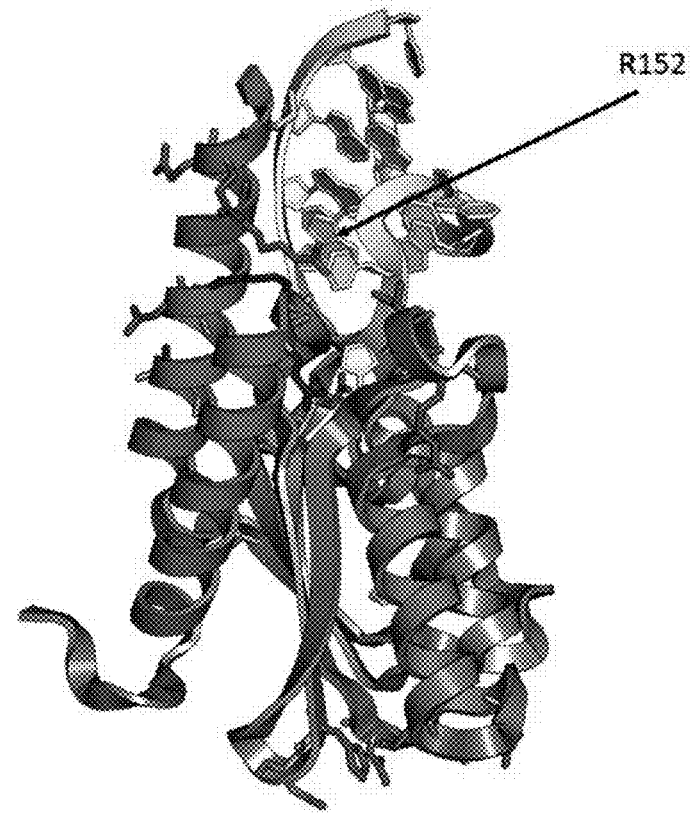
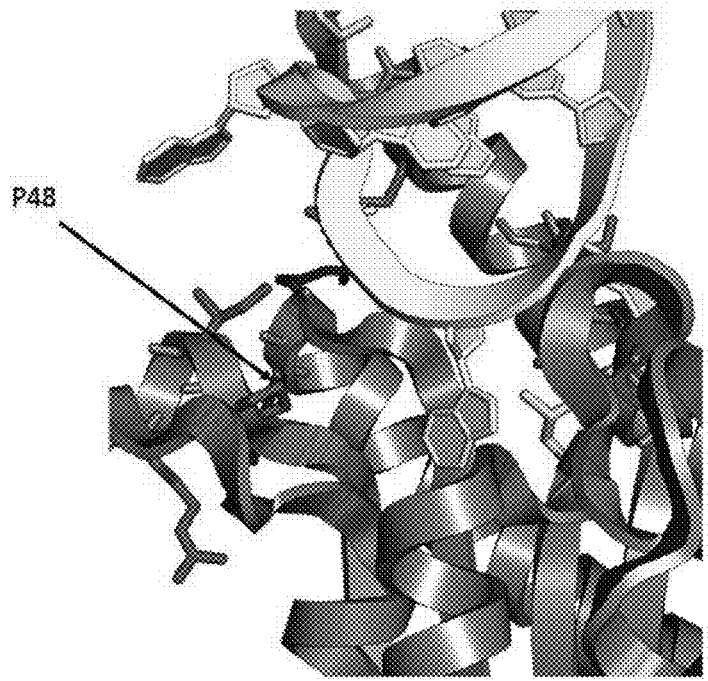
Figure 165

| sgRNA plasmid | protospacer | %editing | ABE | cell line |
|---|---|---|---|---|
| pNMG-510 | GACTCAGATAAGATGCTGAGG | <0.15% | pNMG-478 | R196* TP53 (Calu-6) |
| pNMG-511 | GCATATGTAACAGTTCCTGCA | <0.80% | pNMG-402 | M2371 TP53 (T98G) |
| pNMG-512 | GTGCATGTTTGTGCCCTGTCC | <0.13% | pNMG-477 | R273H TP53 (NCI-H1975) |

```
HEK2: GAACACAAAGCATAGACTGCGGG          GAG: GGAGAGAGAGCATAGACTGCTGG
AAA:  GAAAAAAAAGCAGAGACTGCTGG          GAT: GAAGATAGAGAATAGACTGCTGG
TAC:  GAATACTAAGCATAGACTCCAGG          GAA: GTAGAAAAAGTATAGACTGCAGG
AAC:  GTAAACAAAGCATAGACTGAGGG          AAG: GTCAAGAAAGCAGAGACTGCCGG
GAC:  GAAGACCAAGGATAGACTGCTGG          TAT: GAGTATGAGGCATAGACTGCAGG
CAT:  GAACATAAAGAATAGAATGATGG          TAG: GTCTAGAAAGCTTAGACTGCTGG
                                       CAG: GGACAGGCAGCATAGACTGTGGG
                                       CAA: GAGCAAACAGAATAGACTGTAGG
                                       TAA: GGCTAAAGACCATAGACTGTGGG
                                       AAT: GGGAATAAATCATAGAATCCTGG
```

Figure 178 sgRNA 469: 5'- GAGTATGAGGCATAGACTGC-3'    Figure 180 sgRNA 472: 5'-GAGCAAAGACAATACACTGT-3'    Figure 182 sgRNA 536: 5'-GGATTGACCCAGGCCAGGGC-3'

ADENOSINE NUCLEOBASE EDITORS AND USES THEREOF

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases. Since many genetic diseases in principle can be treated by effecting a specific nucleotide change at a specific location in the genome (for example, an A to G or a T to C change in a specific codon of a gene associated with a disease), the development of a programmable way to achieve such precise gene editing represents both a powerful new research tool, as well as a potential new approach to gene editing-based therapeutics.

SUMMARY OF THE INVENTION

Provided herein are compositions, kits, and methods of modifying a polynucleotide (e.g., DNA) using an adenosine deaminase and a nucleic acid programmable DNA binding protein (e.g., Cas9) Some aspects of the disclosure provide nucleobase editing proteins which catalyze hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). To overcome this drawback, the first deoxyadenosine deaminases were evolved to accept DNA substrates and deaminate deoxyadenosine (dA) to deoxyinosine. The adenosine deaminase acting on tRNA (ADAT) from *Escherichia coli* (TadA, for tRNA adenosine deaminase A), was covalently fused to a dCas9 domain, and libraries of this fusion were assembled containing mutations in the deaminase portion of the construct. It should be appreciated that *E. coli* TadA (ecTadA) deaminases also include truncations of ecTadA. For example, truncations (e.g., N-terminal truncations) of a full length ecTadA (SEQ ID NO: 84), such as the N-terminally truncated ecTadA set forth in SEQ ID NO: 1 are provided herein for use in the present invention. Further, it was found that other adenosine deaminase mutants, such as *S. aureus* TadA mutants, were capable of deaminating adenosine. Without wishing to be bound by any particular theory, truncations of adenosine deaminases (e.g., ecTadA) may have desired solubility and/or expression properties as compared to their full-length counterparts.

Mutations in the deaminase domain of nucleobase editing proteins were made by evolving adenosine deaminases. Productive variants were identified via selection for A to G reversion at the codon of an active-site His in the acetyltransferase gene of chloramphenicol (encoded on a co-transformed selection plasmid). A first round of evolution yielded an ecTadA variant, ecTadA D108X (X=G, V, or N), capable of converting A to G in DNA. In some embodiments, the ecTadA variant comprises a D108A mutation in SEQ ID NO: 1, or a corresponding mutation in another adenosine deaminase. The first round of evolution also yielded an ecTadA variant, ecTadA A106V. A subsequent round of evolution resulted in another variant, ecTadA D108N_E155X (X=G, V, or D), which *E. coli* survive in the presence of high concentrations of chloramphenicol. Additional variants were identified by evolving ecTadA. For example, ecTadA variants that are capable of deaminating adenosine in DNA include one or more of the following mutations D108N, A106V, D147, E155V, L84F, H123Y, and I157F of SEQ ID NO: 1. It should be appreciated however, that homologous mutations may be made in other adenosine deaminases to generate variants that are capable of deaminating adenosine in DNA. Additional rounds of evolution provided further ecTadA variants. For example, additional ecTadA variants are shown in FIGS. 11, 16, 97, 104-106, 125-128, 115 and Table 4.

In the examples provided herein, exemplary nucleobase editors having the general structure evolved ecTadA (D108X; X=G, V, or N)-XTEN-nCas9, catalyzed A to G transition mutations in cells such as eukaryotic cells (e.g., Hek293T mammalian cells). In other examples exemplary nucleobase editors contain two ecTadA domains and a nucleic acid programmable DNA binding protein (napDNAbp). For example nucleobase editors may have the general structure ecTadA(D108N)-ecTadA(D108N)-nCas9. Additional examples of nucleobase editors containing ecTadA variants provided herein demonstrate an improvement in performance of the nucleobase editors in mammalian cells. For example, certain adenosine base editors include ecTadA having D108X, where X=G, V, or N, and/or E155X, where X=B, V, or D mutations in ecTadA as set forth in SEQ ID NO: 1 or another adenine deaminase. In certain embodiments mutants, nucleobase editors are covalently fused to catalytically dead alkyl adenosine gylcosylase (AAG), which may protect the edited inosine from base excision repair (or other DNA repair systems) until the T on the opposite strand is changed to a C, for example, through mismatch repair (or other DNA repair systems). Once the base opposite the inosine is changed to a C, then the inosine may be changed to a G irreversibly and permanently through cellular DNA repair processes, resulting in a permanent change from an A:T base pair to a G:C base pair.

Without wishing to be bound by any particular theory, the adenosine nucleobase editors described herein work by using ecTadA variants to deaminate A bases in DNA, causing A to G mutations via inosine formation. Inosine preferentially hydrogen bonds with C, resulting in A to G mutation during DNA replication. When covalently tethered to Cas9 (or another nucleic acid programmable DNA binding protein), the adenosine deaminase (e.g., ecTadA) is localized to a gene of interest and catalyzes A to G mutations in the ssDNA substrate. This editor can be used to target and revert single nucleotide polymorphisms (SNPs) in disease-relevant genes, which require A to G reversion. This editor can also be used to target and revert single nucleotide polymorphisms (SNPs) in disease-relevant genes, which require T to C reversion by mutating the A, opposite of the T, to a G. The T may then be replaced with a C, for example by base excision repair mechanisms, or may be changed in subsequent rounds of DNA replication.

Some aspects of the disclosure relate to the discovery that engineered (e.g., evolved) adenosine deaminases are capable of deaminating adenosine in a deoxyribonucleic acid (DNA) substrate. In some embodiments, the disclosure provides such adenosine deaminases. In some embodiments, the adenosine deaminases provided herein are capable of deaminating an adenosine in a DNA molecule. Other aspects of the disclosure provide fusion proteins comprising a Cas9 domain and an adenosine deaminase domain, for example, an engineered deaminase domain capable of deaminating an adenosine in DNA. In some embodiments, the fusion protein comprises one or more of a nuclear localization sequence (NLS), an inhibitor of inosine base excision repair (e.g., dISN), and/or a linker.

In some aspects, the disclosure provides an adenosine deaminase capable of deaminating an adenosine in a deoxyribonucleic acid (DNA) substrate. In some embodiments, the adenosine deaminase is from a bacterium, for example, *E. coli* or *S. aureus*. In some embodiments, the adenosine deaminase is a TadA deaminase. In some embodiments, the TadA deaminase is an *E. coli* TadA deaminase (ecTadA). In some embodiments, the adenosine deaminase comprises a D108X mutation in SEQ ID NO: 1, or a corresponding mutation in another adenosine deaminase, wherein X is any amino acid other than the amino acid found in the wild-type protein. In some embodiments, X is G, N, V, A, or Y.

In some embodiments, the adenosine deaminase comprises a E155X mutation in SEQ ID NO: 1, or a corresponding mutation in another adenosine deaminase, wherein X is any amino acid other than the amino acid found in the wild-type protein. In some embodiments, X is D, G, or V. It should be appreciated that the adenosine deaminases provided herein may contain one or more of the mutations provided herein in any combination.

Some aspects of the disclosure provide a fusion protein comprising: (i) a Cas9 domain, and (ii) an adenosine deaminase, such as any of the adenosine deaminases provided herein. In some embodiments, the Cas9 domain of the fusion protein is a nuclease dead Cas9 (dCas9), a Cas9 nickase (nCas9), or a nuclease active Cas9. In some embodiments, the fusion protein further comprises an inhibitor of inosine base excision repair, for example a dISN or a single stranded DNA binding protein. In some embodiments, the fusion protein comprises one or more linkers used to attach an adenine deaminase (e.g., ecTadA) to a nucleic acid programmable DNA binding protein (e.g., Cas9). In some embodiments, the fusion protein comprises one or more nuclear localization sequences (NLS).

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 12 shows the colony forming units (C.F.U.) of various constructs challenged on increasing concentrations of chloramphenicol. The construct numbers correspond to those listed in FIG. 11.

Figure 15B:
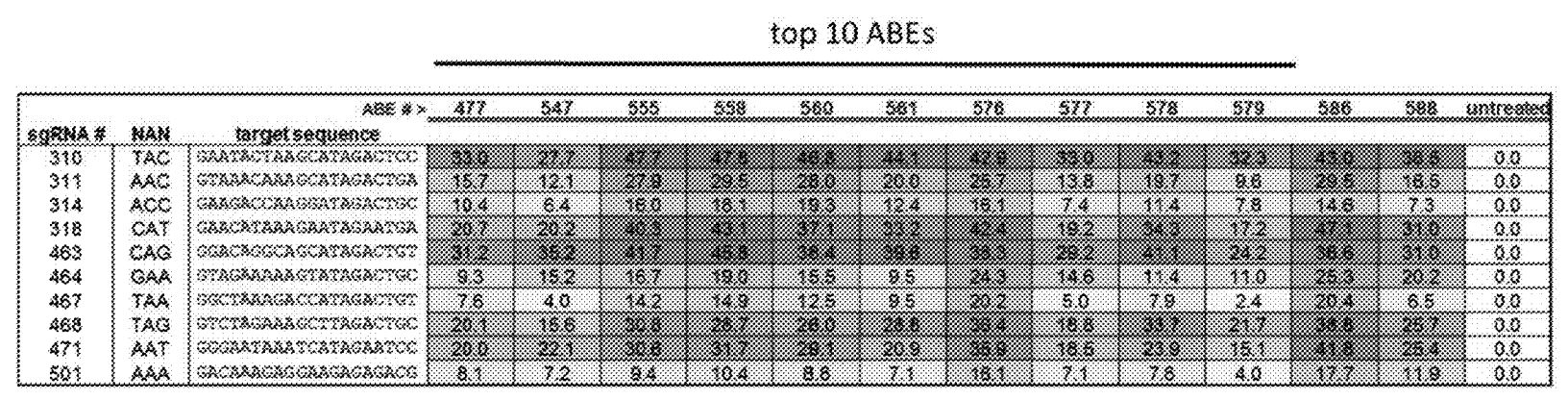

FIG. 15 is a schematic showing the development of ABE.

FIG. 16 is a table showing the results of clones assayed after second round evolution. Columns 1, 8, and 10 represent mutations from the first round evolution. Columns 11 and 14 represent the consensus mutations from second round evolution.

Figure 21:
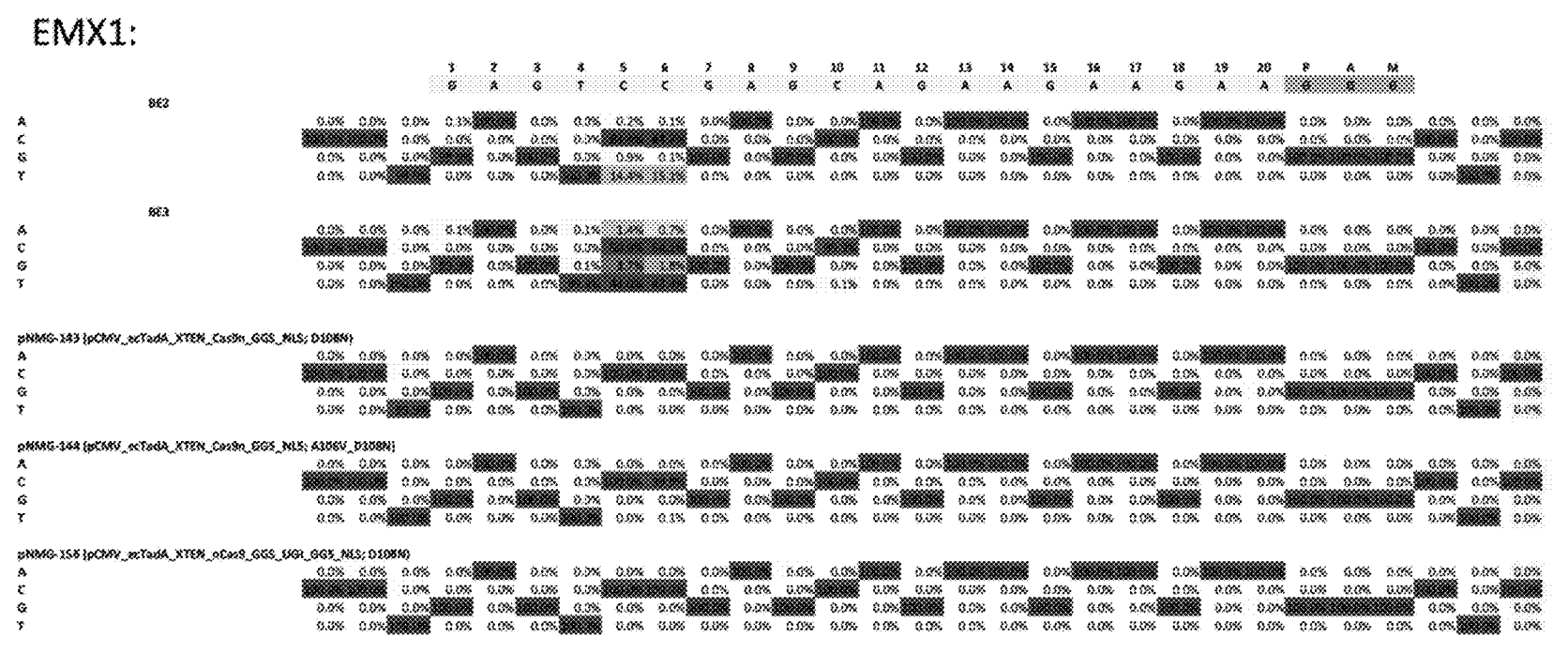

FIG. 21 shows that ABE operates best on 1 of 6 genomic sites tested. The sequence corresponds to SEQ ID NO: 46.

FIG. 24 shows inactive C-terminal Cas9 fusions of ecTadA for pNMG-174 through pNMG-177. The sequence corresponds to SEQ ID NO: 41.

FIG. 25 shows the editing results from ecTadA nucleobase editors (pNMG-143, pNMG-144, pNMG-164, and pNMG-177). The sequence corresponds to SEQ ID NO: 41.

FIG. 26 shows the editing results from ecTadA nucleobase editors (pNMG-164, pNMG-177, pNMG-178, pNMG-179, and pNMG-180). The sequence corresponds to SEQ ID NO: 41.

FIG. 27 shows the results of editing at the Hek-3 site. The sequence corresponds to SEQ ID NO: 42.

Figure 28:
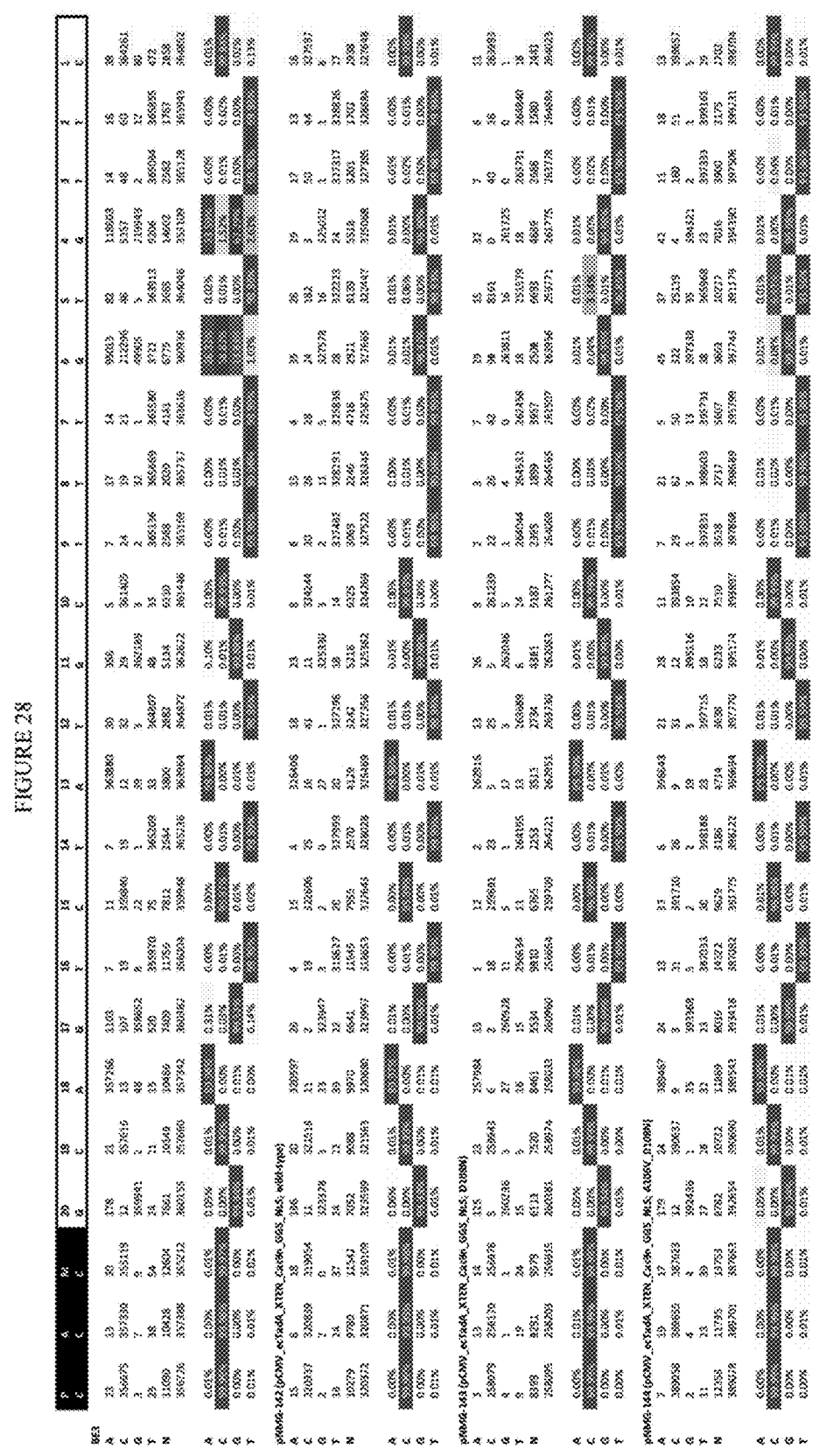
Figure 28:
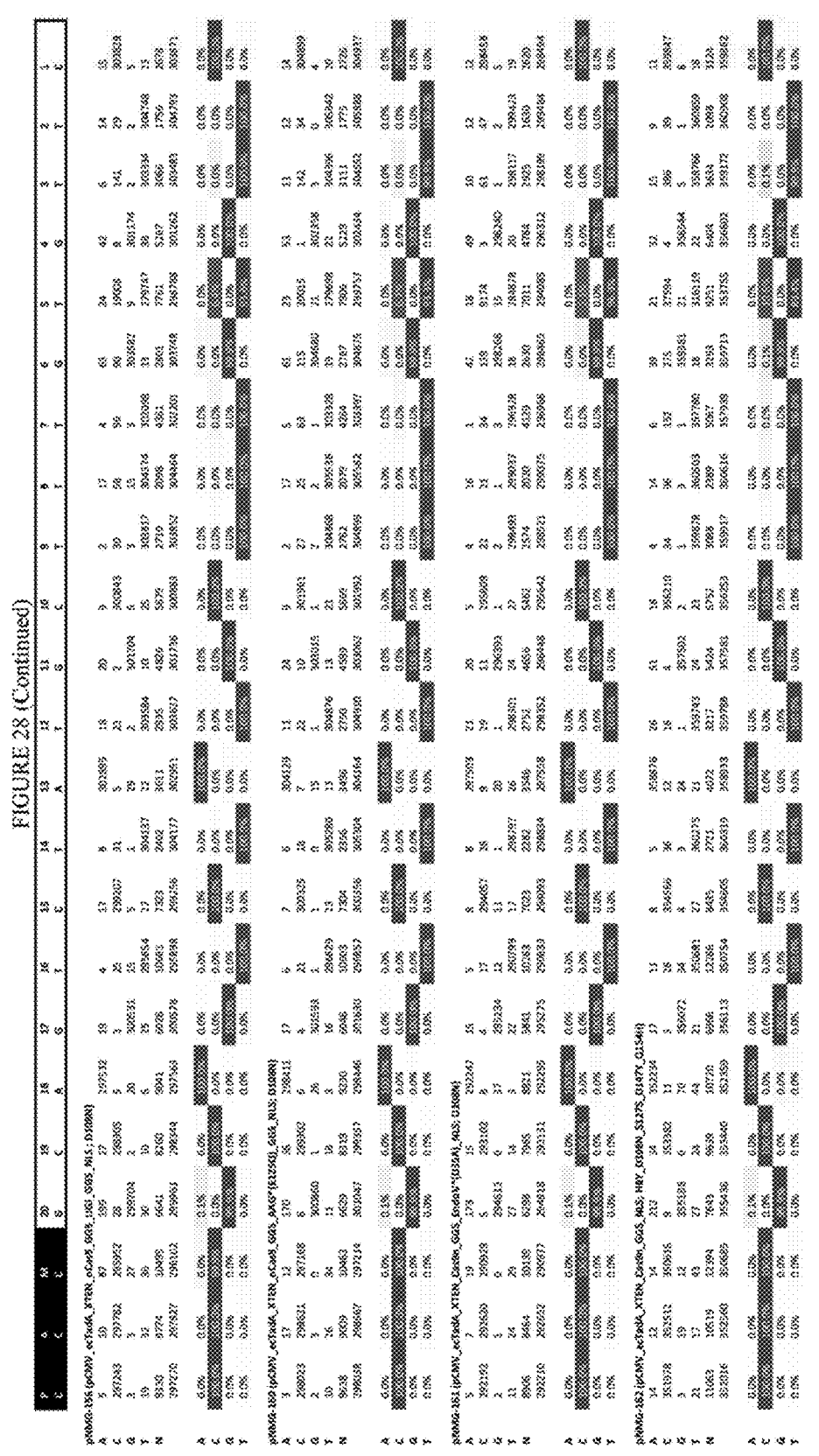
Figure 28:
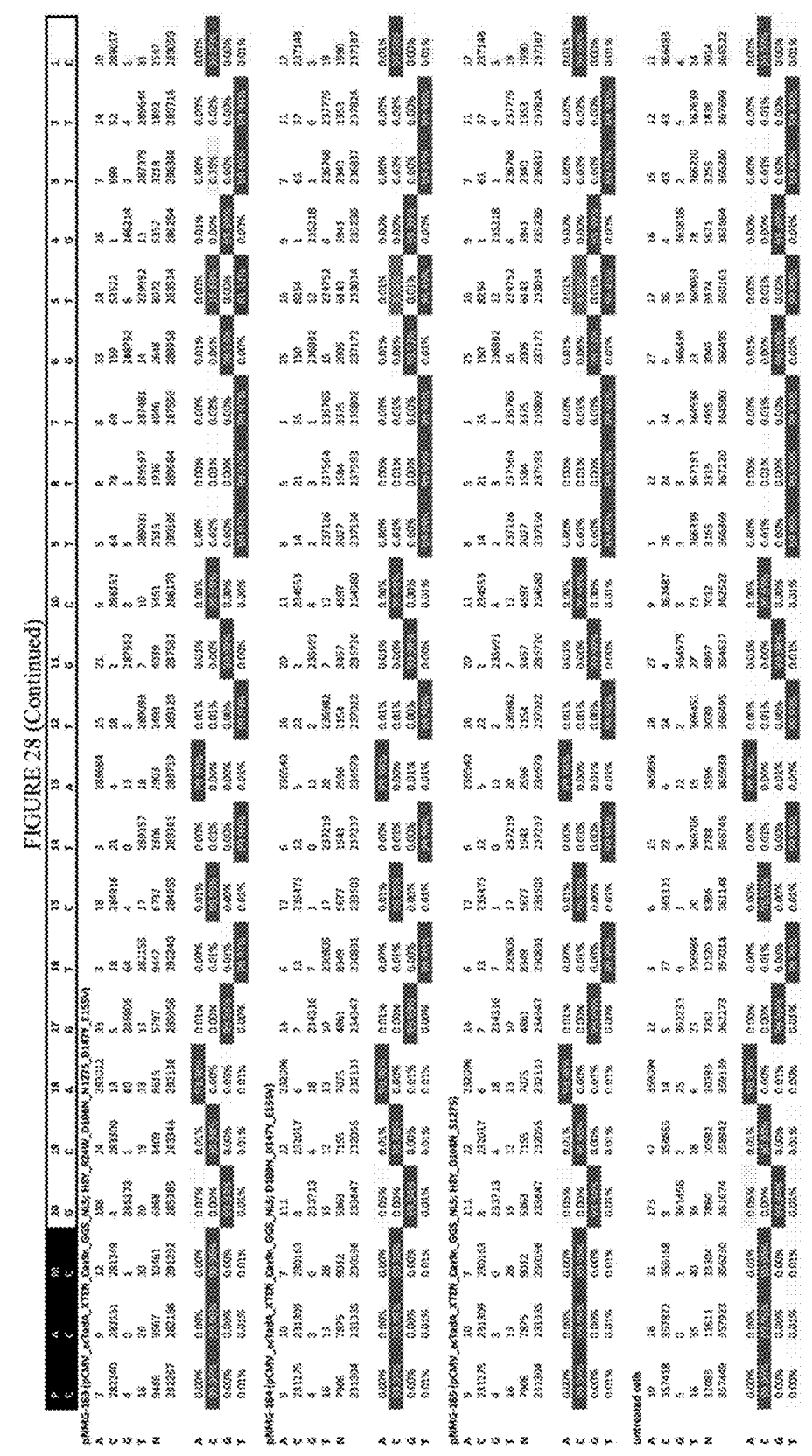

FIG. 28 shows the results of editing at the Hek-2 site. The sequence corresponds to SEQ ID NO: 41.

Figure 29:
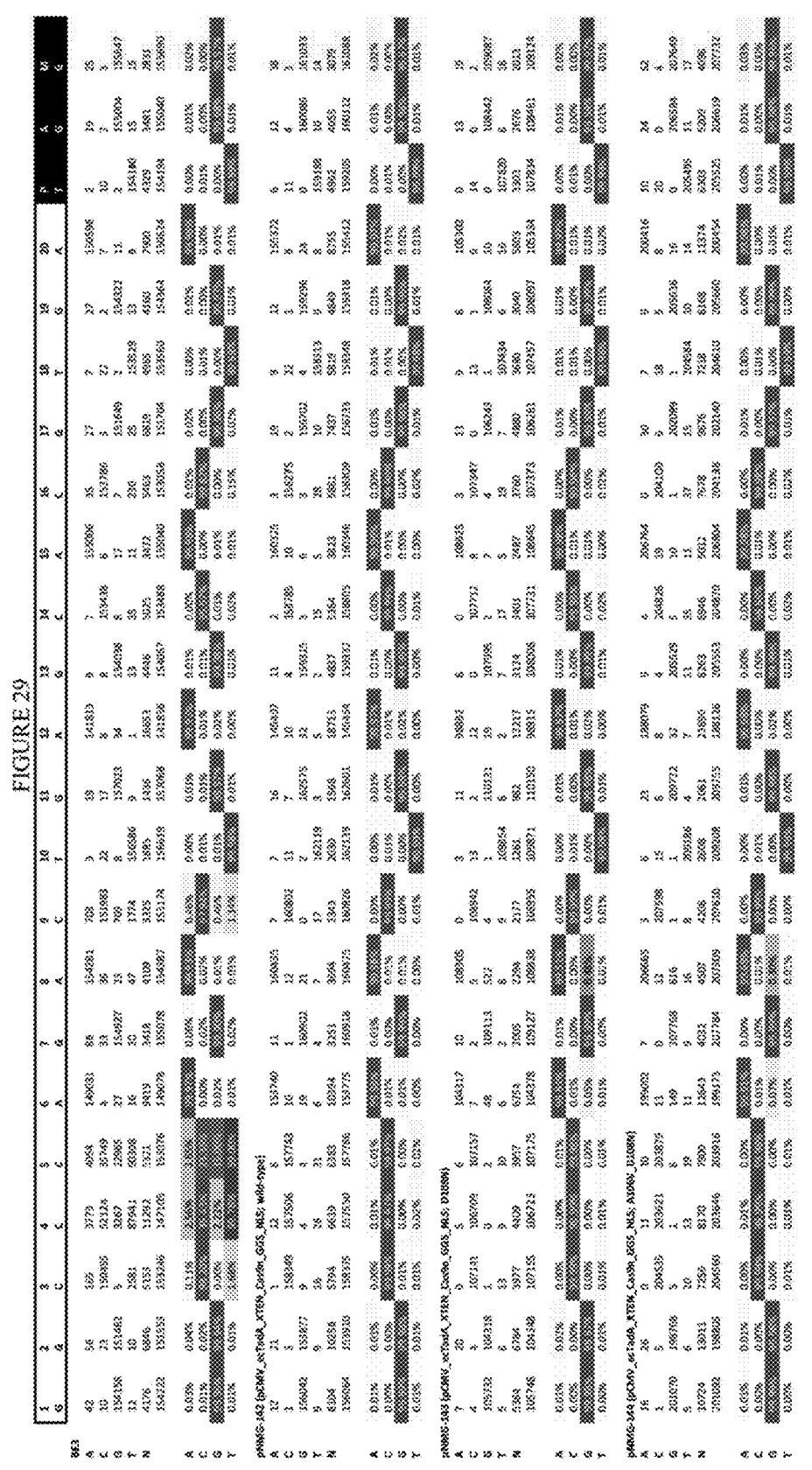
Figure 29:
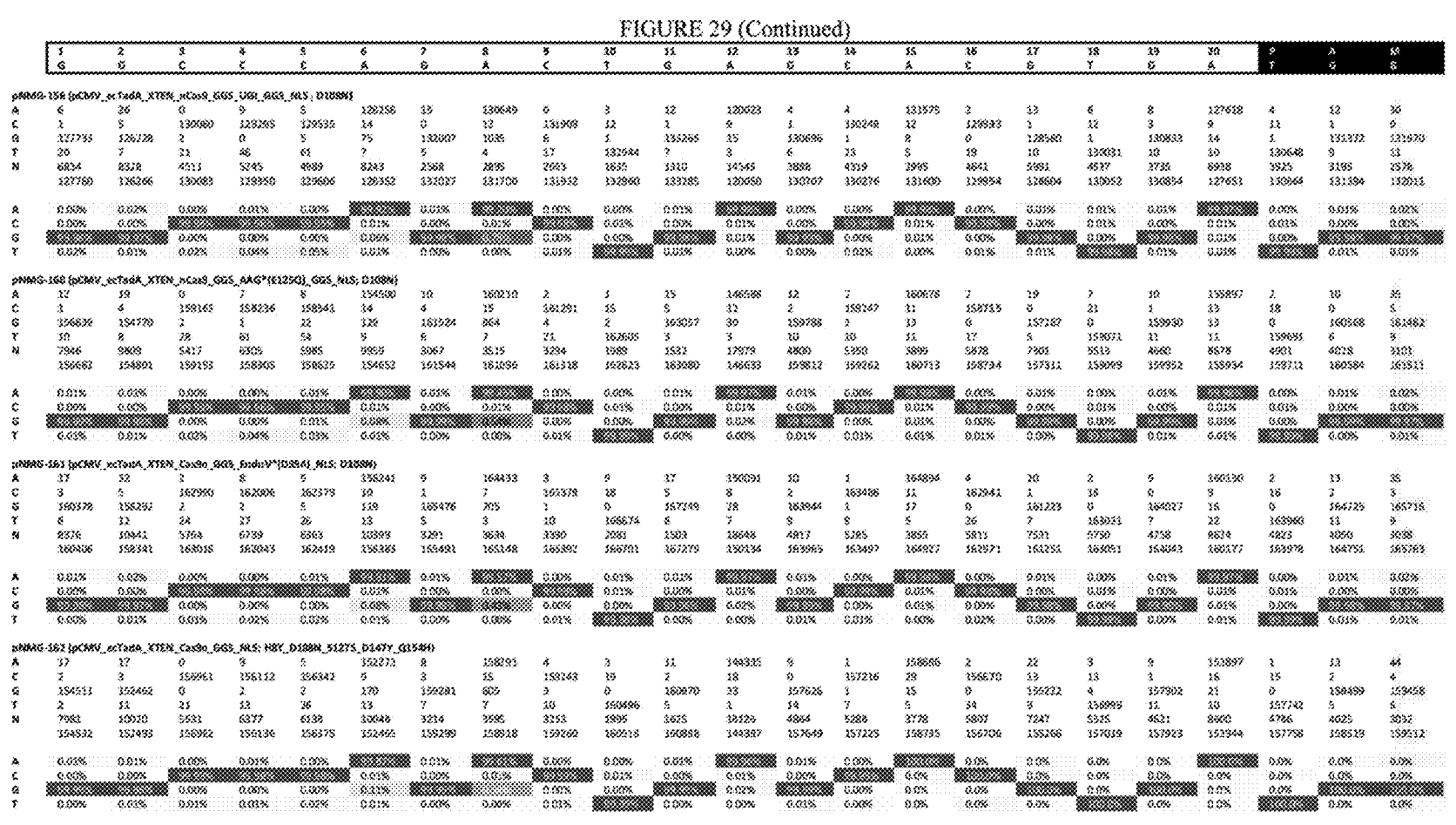
Figure 29:
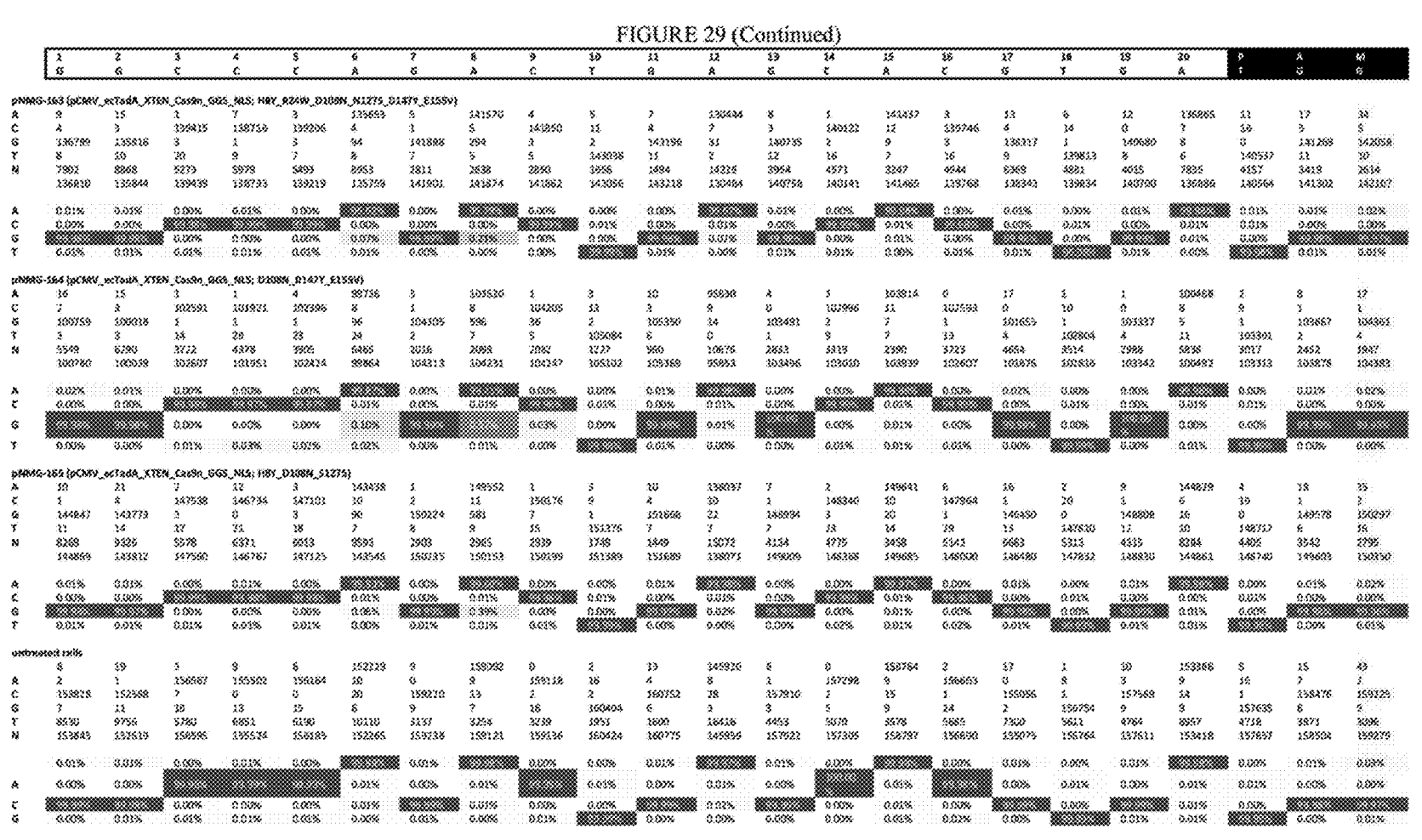

FIG. 29 shows the results of editing at the Hek-3 site. The sequence corresponds to SEQ ID NO: 42.

Figure 30:
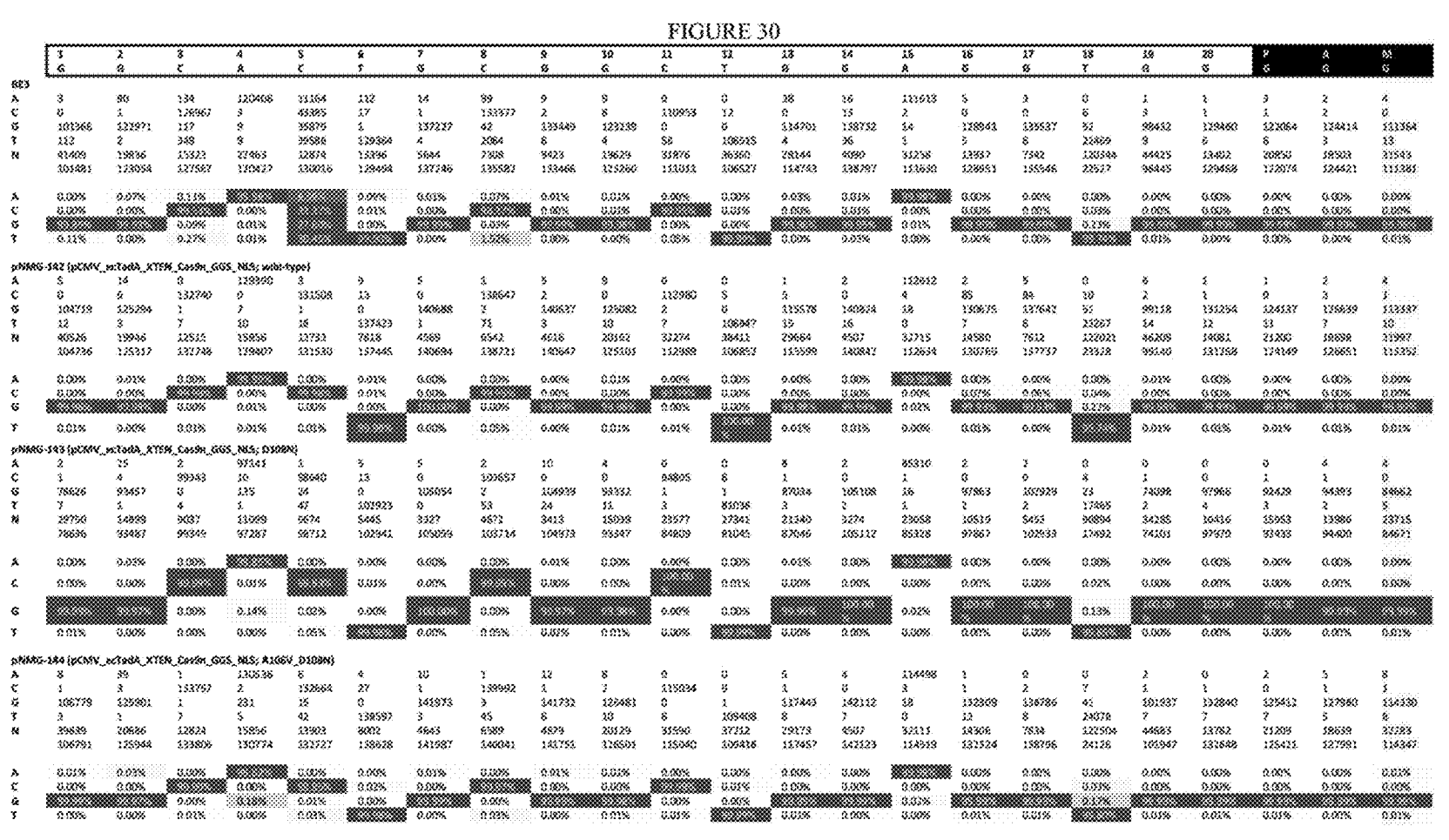
Figure 30:
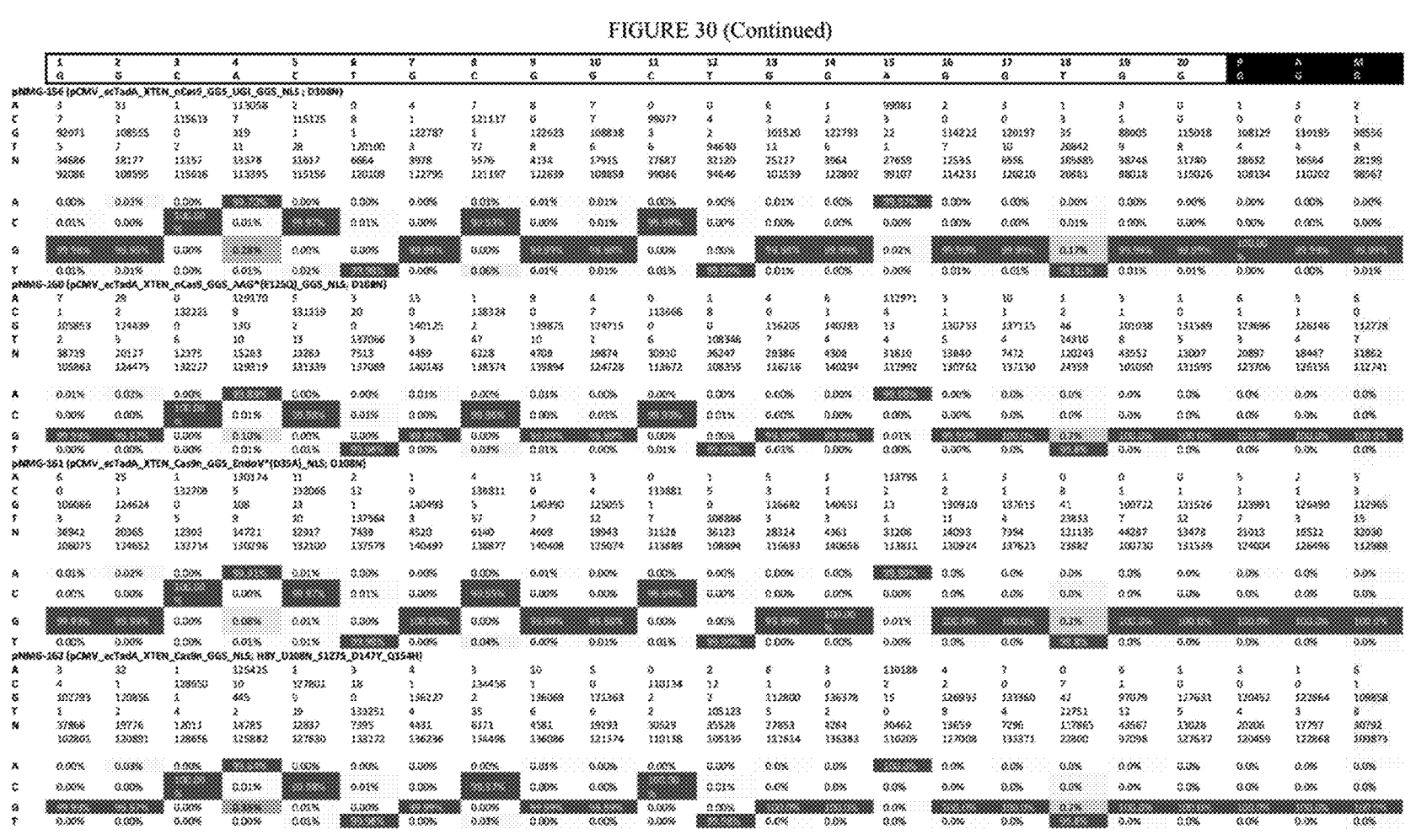
Figure 30:
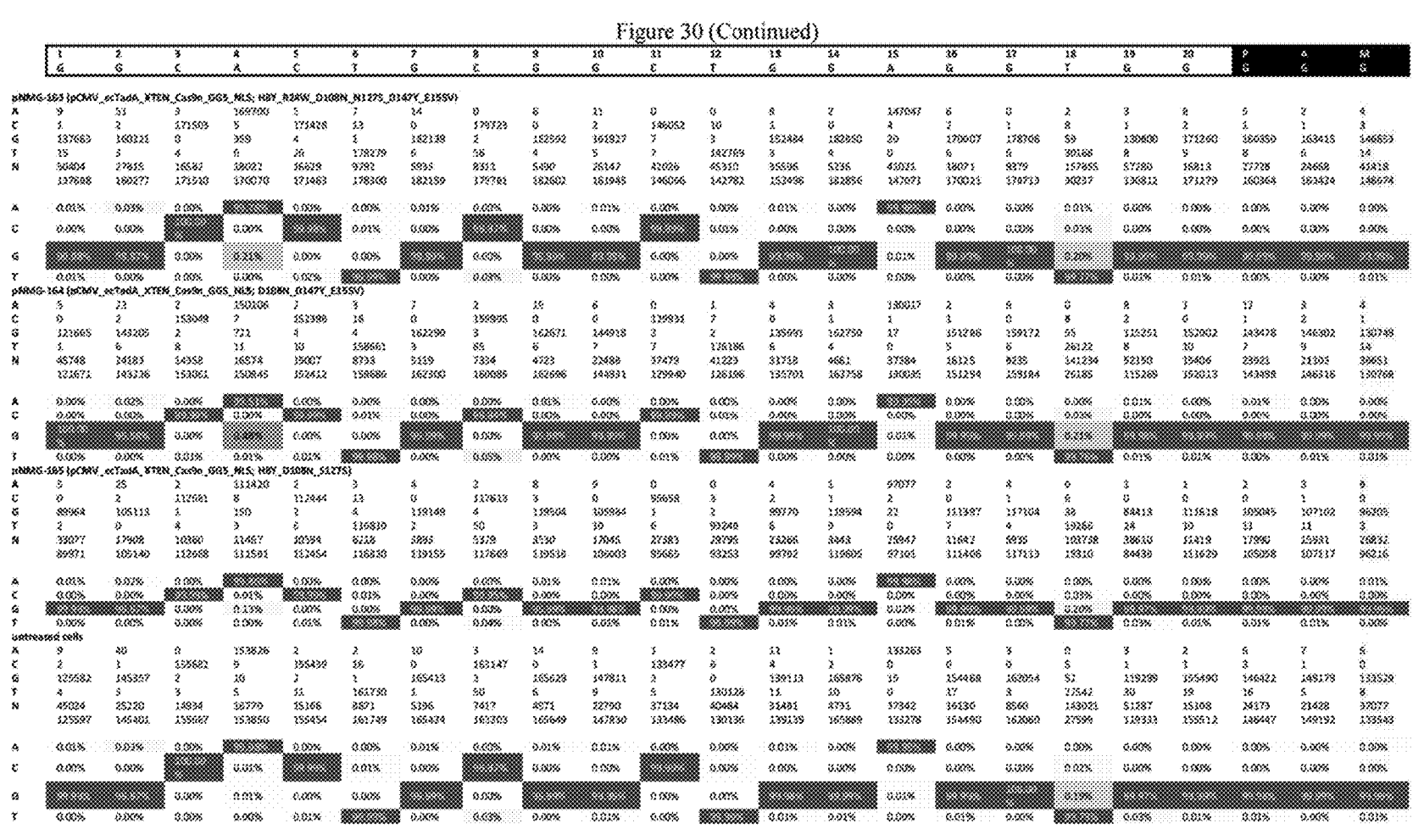

FIG. 30 shows the results of editing at the Hek-4 site. The sequence corresponds to SEQ ID NO: 43.

Figure 31:
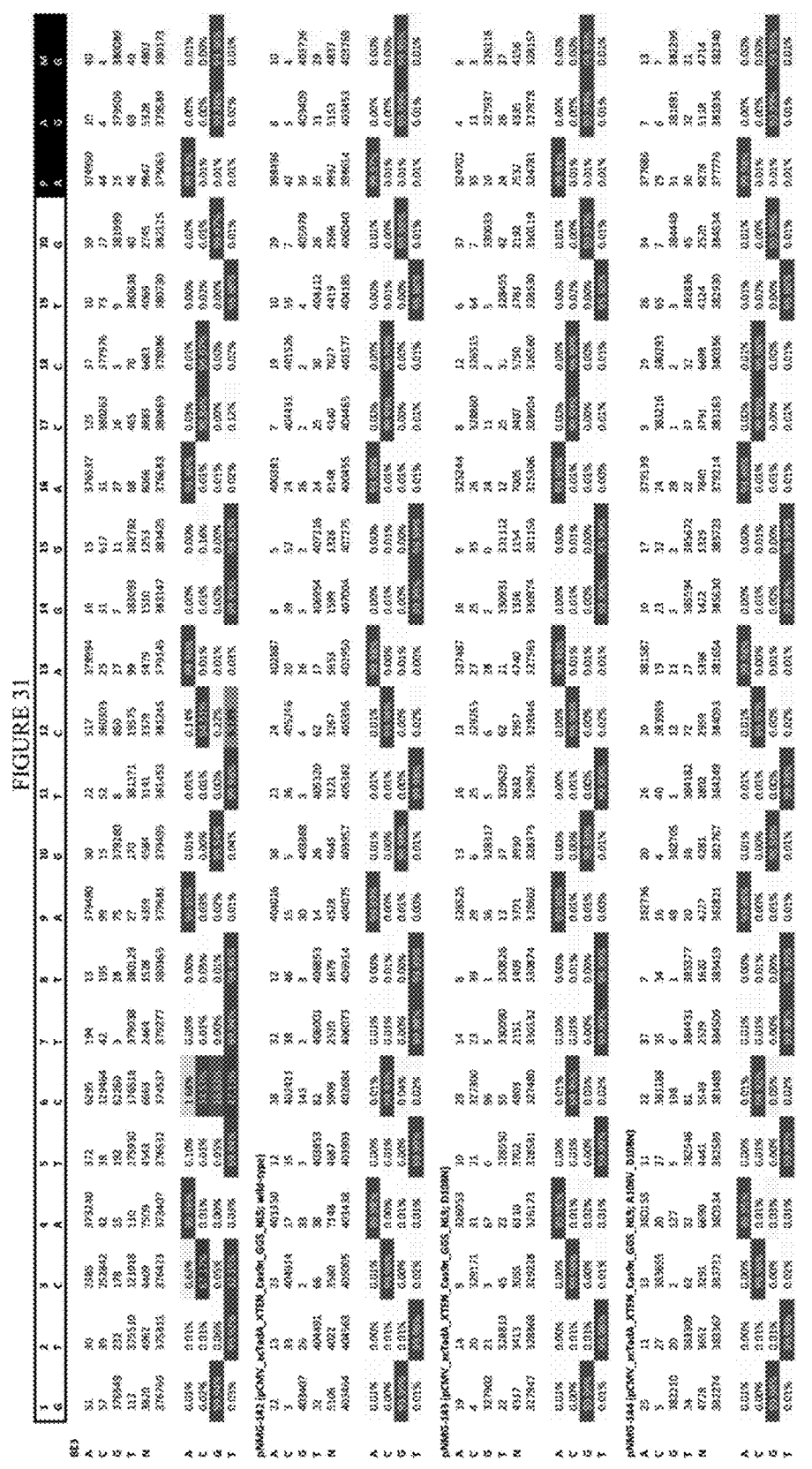
Figure 31:
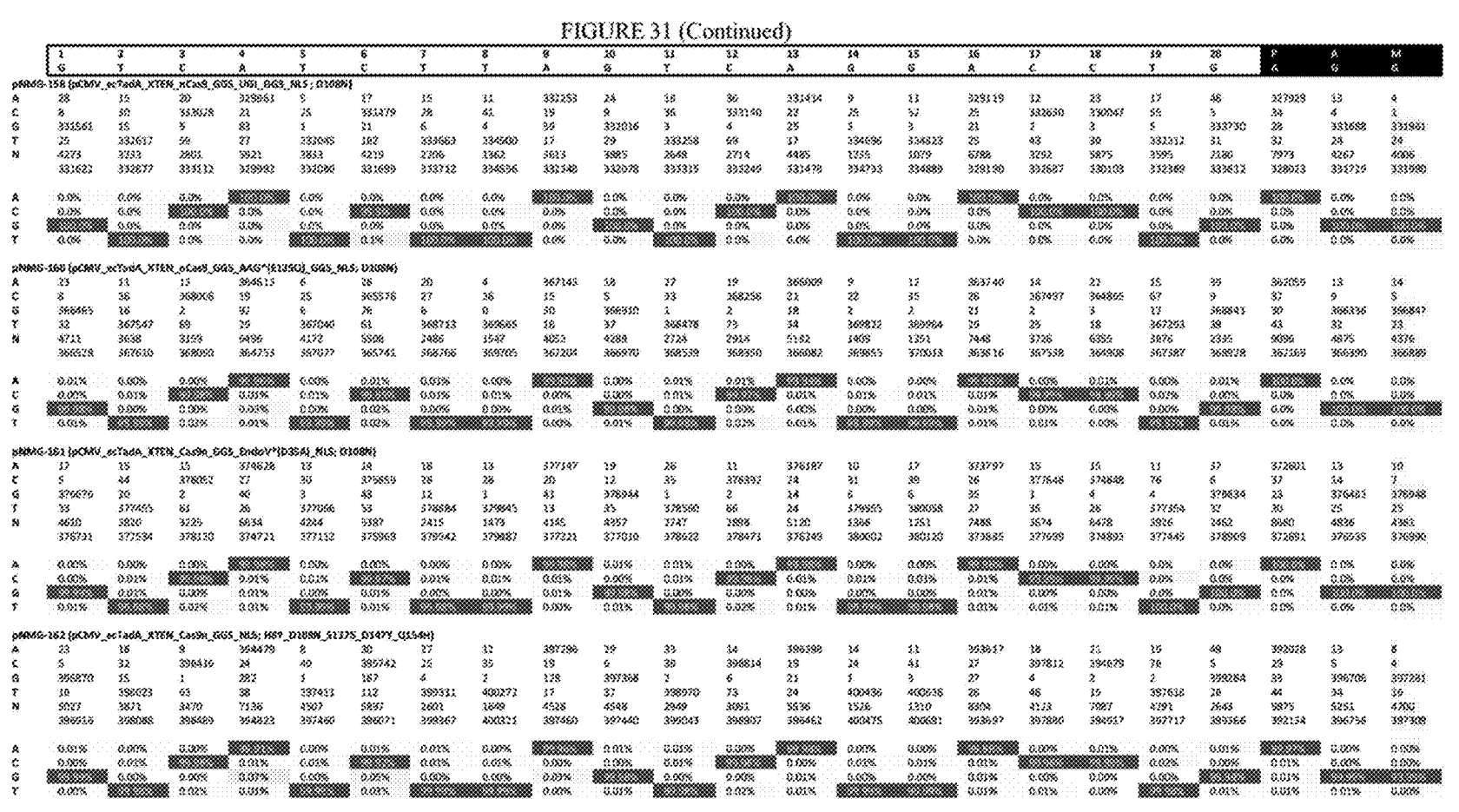
Figure 31:
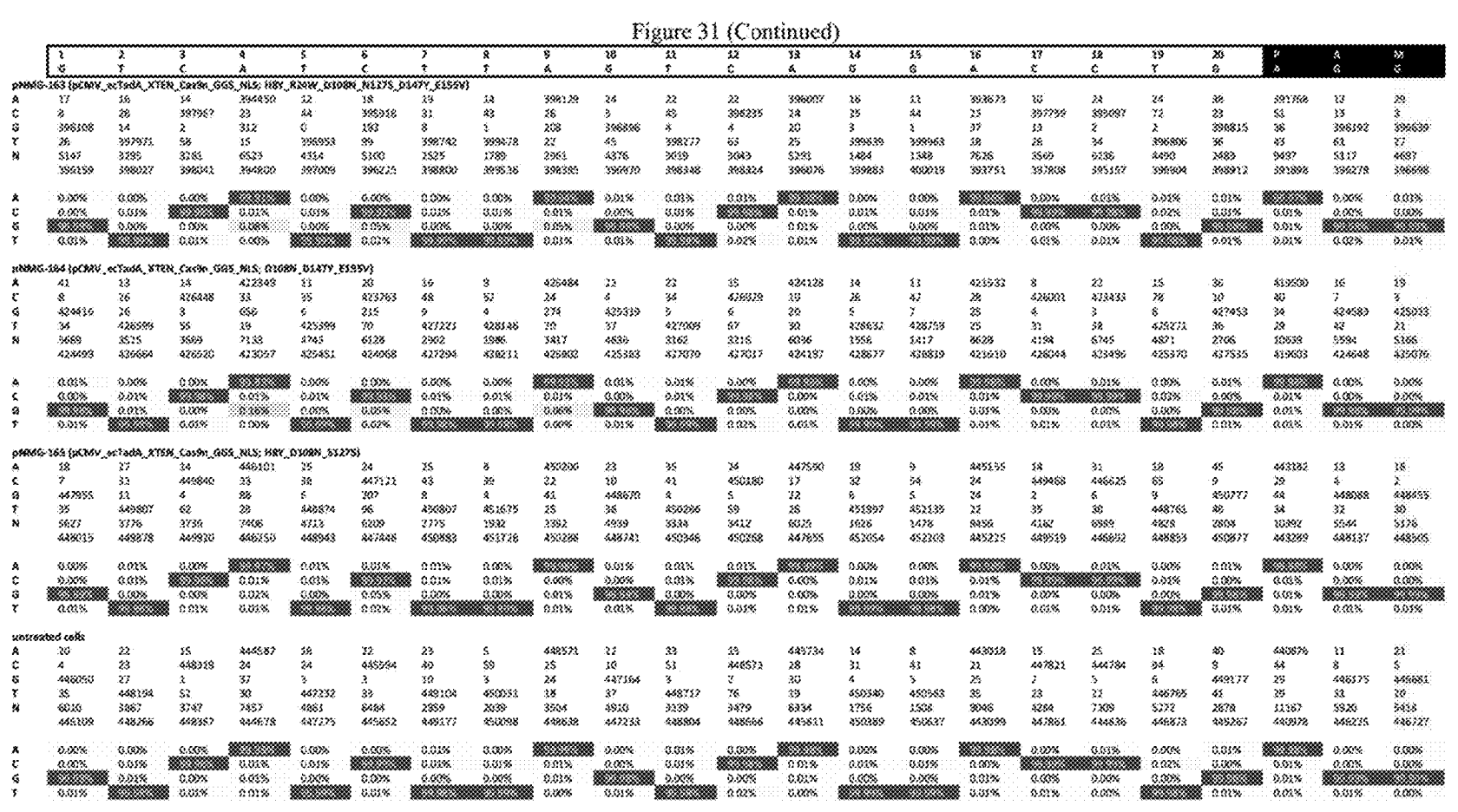

FIG. 31 shows the results of editing at the RNF-2 site. The sequence corresponds to SEQ ID NO: 44.

Figure 32:
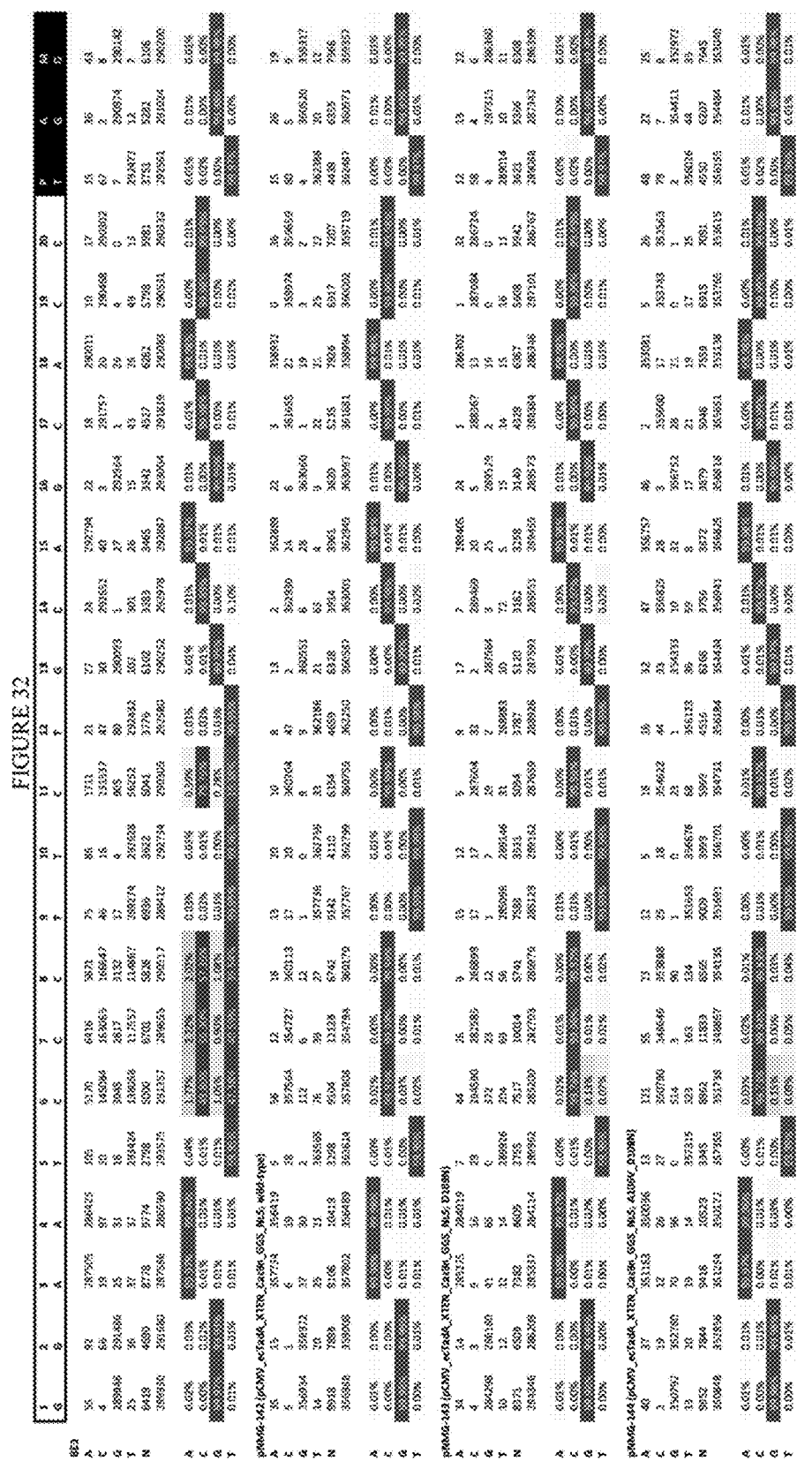
Figure 32:
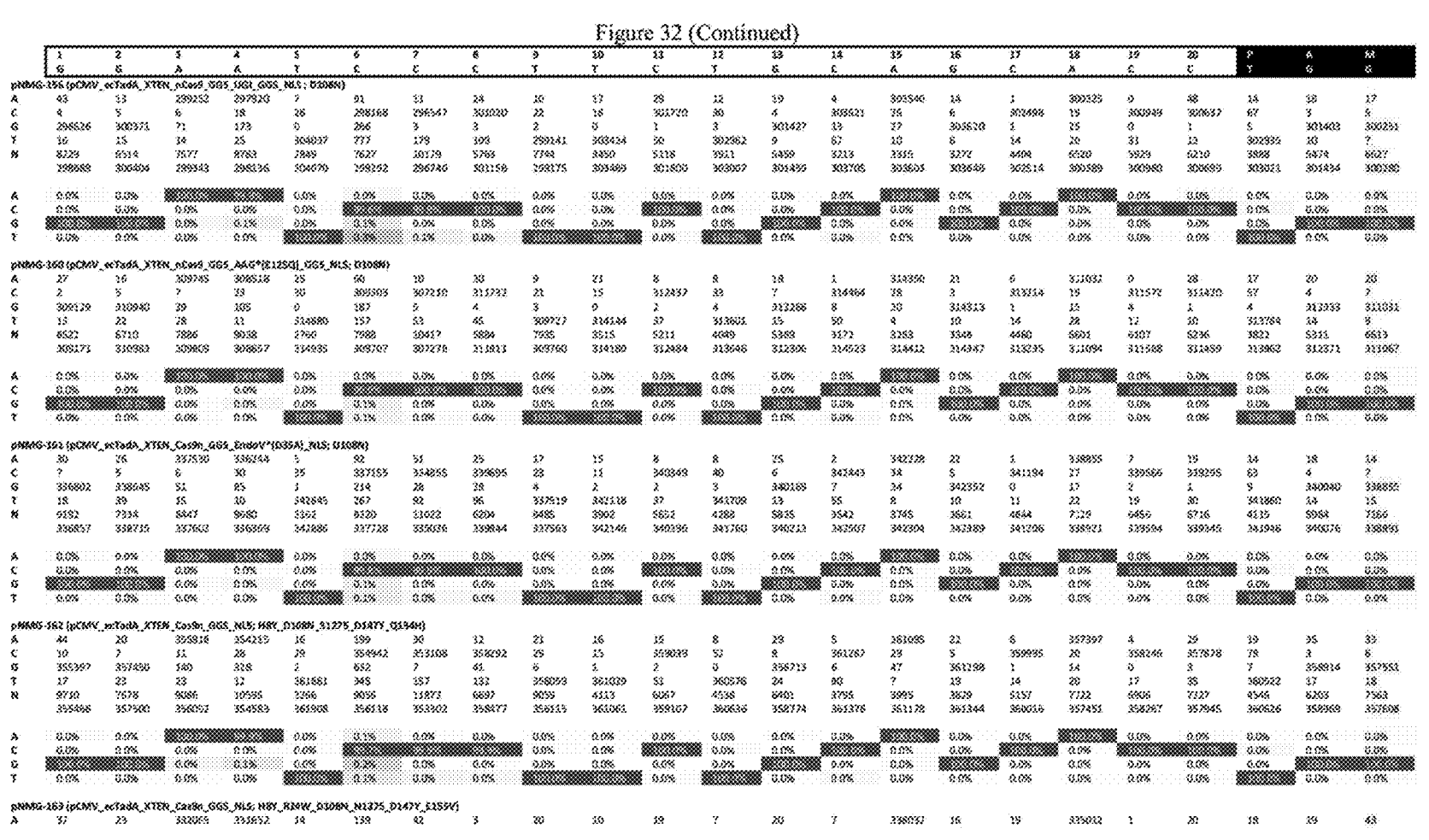
Figure 32:
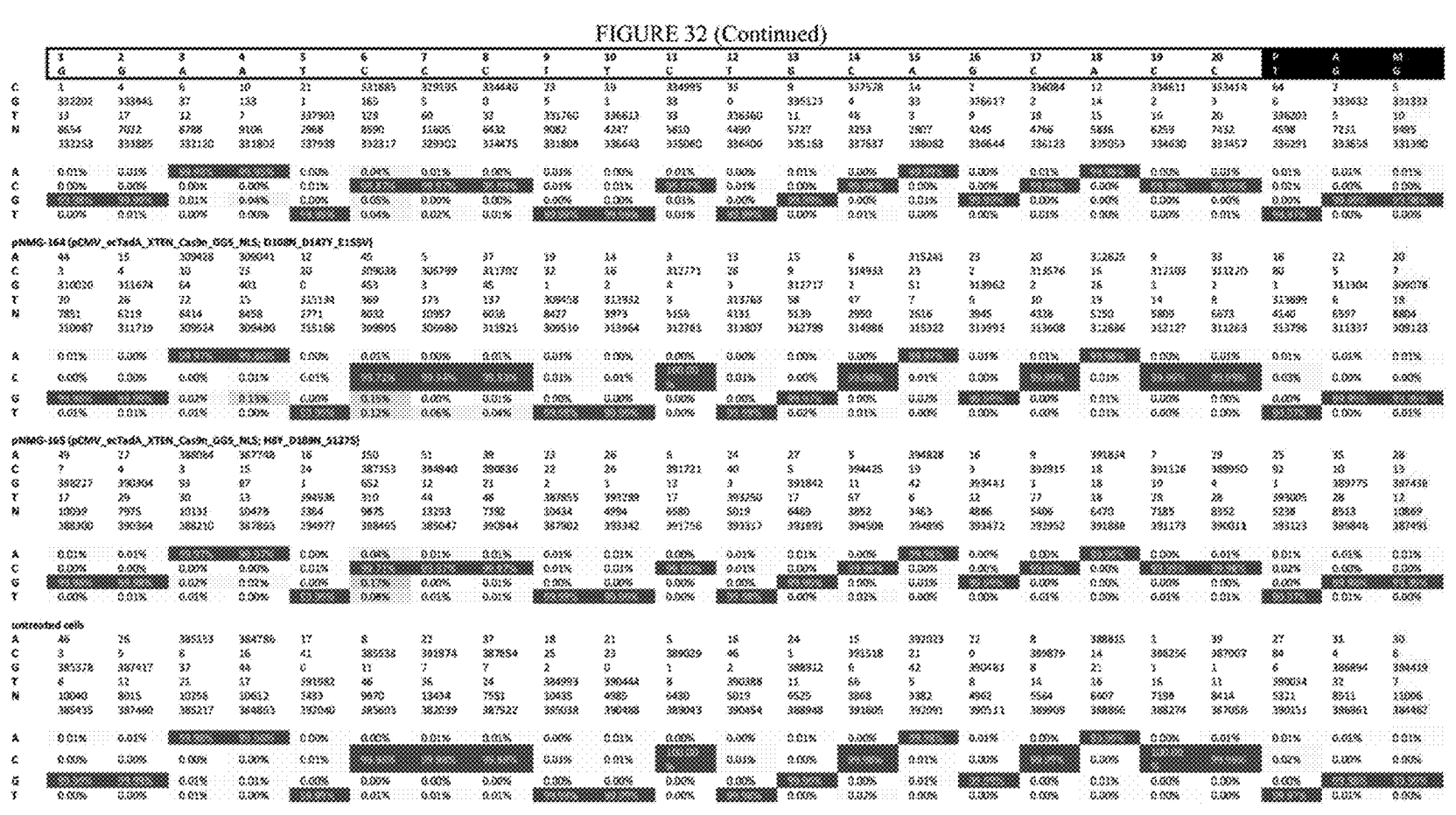

FIG. 32 shows the results of editing at the FANCF site. The sequence corresponds to SEQ ID NO: 45.

Figure 33:
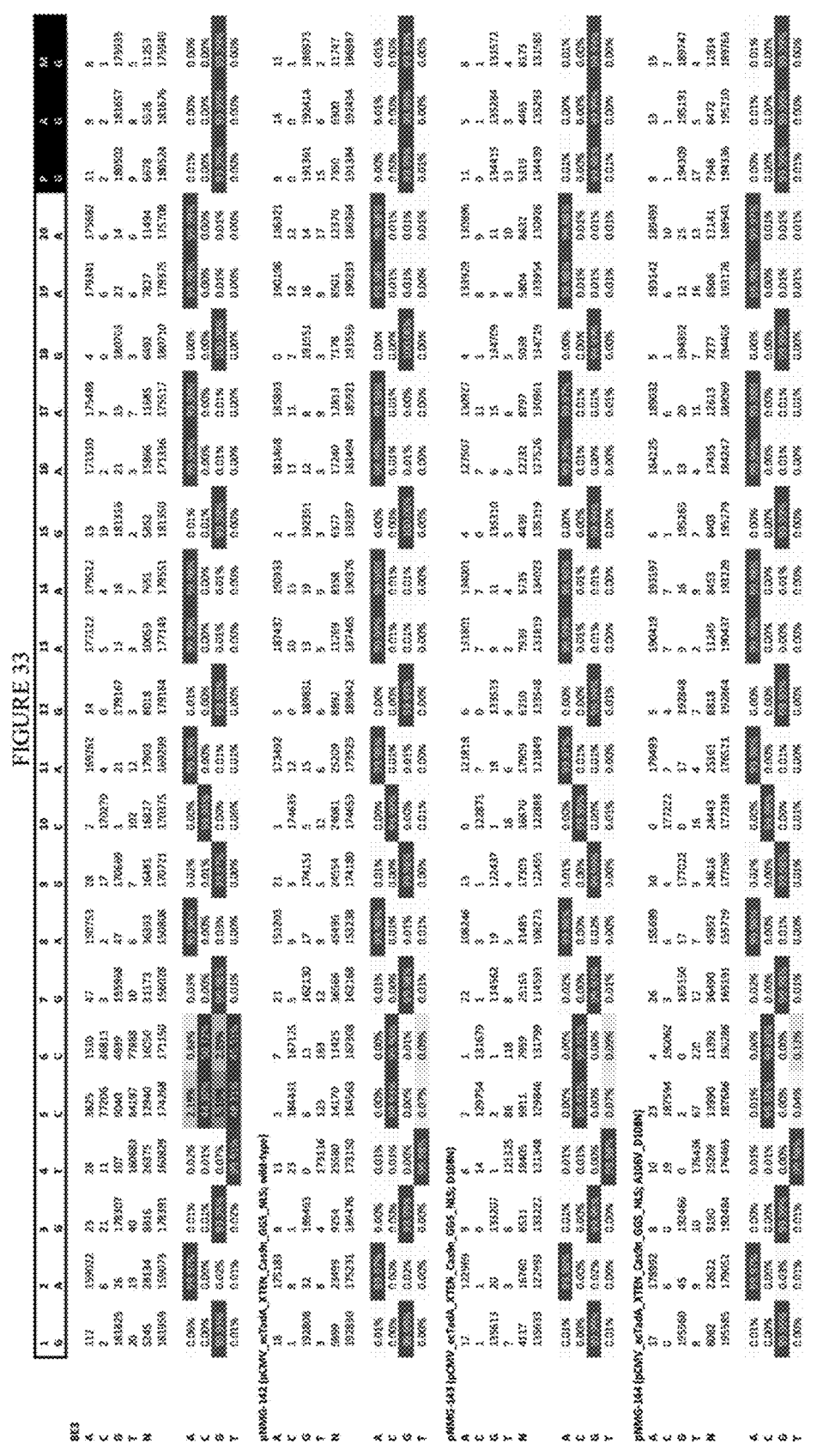
Figure 33:
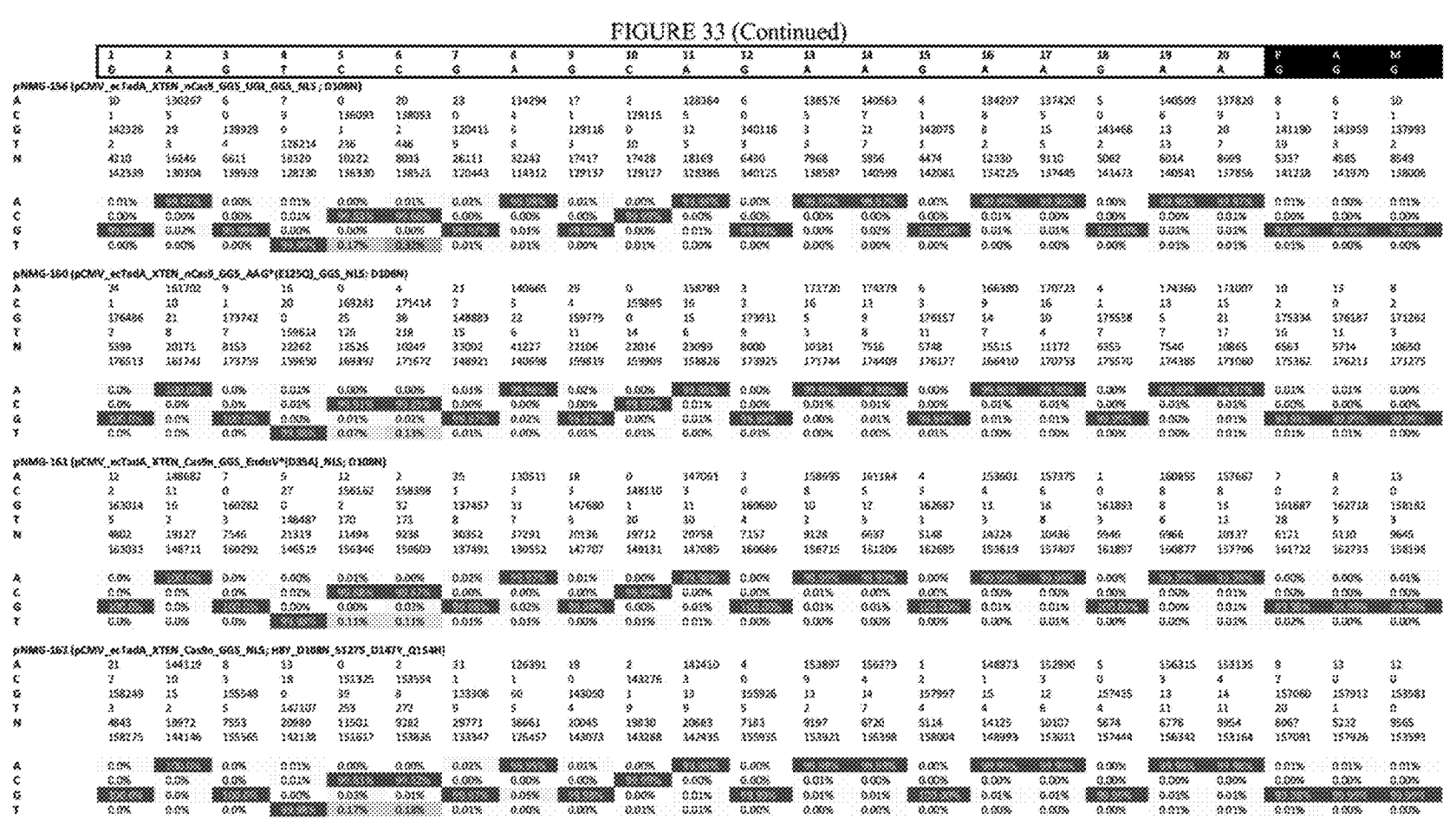
Figure 33:
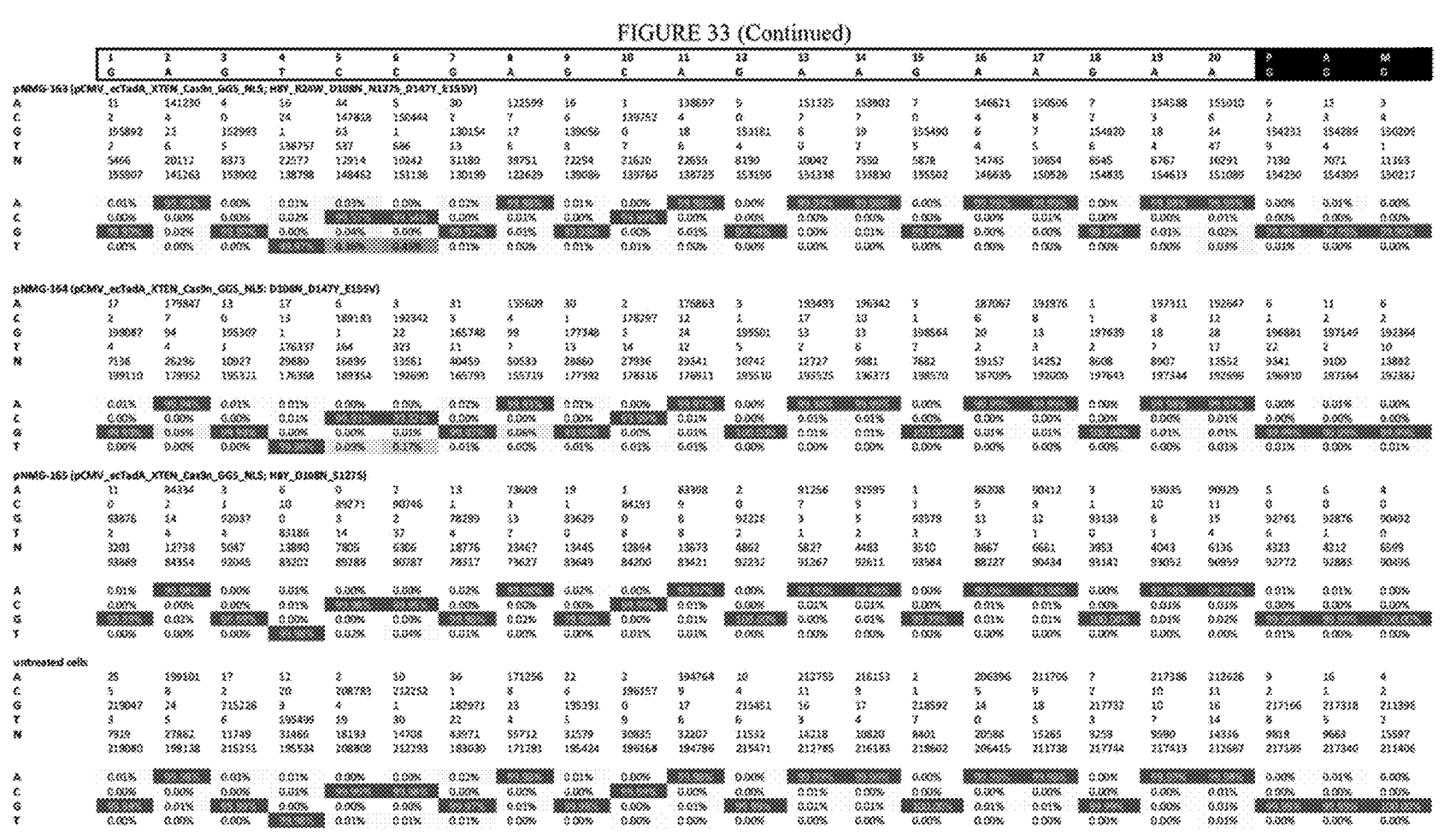

FIG. 33 shows the results of editing at the EMX-1 site. The sequence corresponds to SEQ ID NO: 46.

Figure 34:
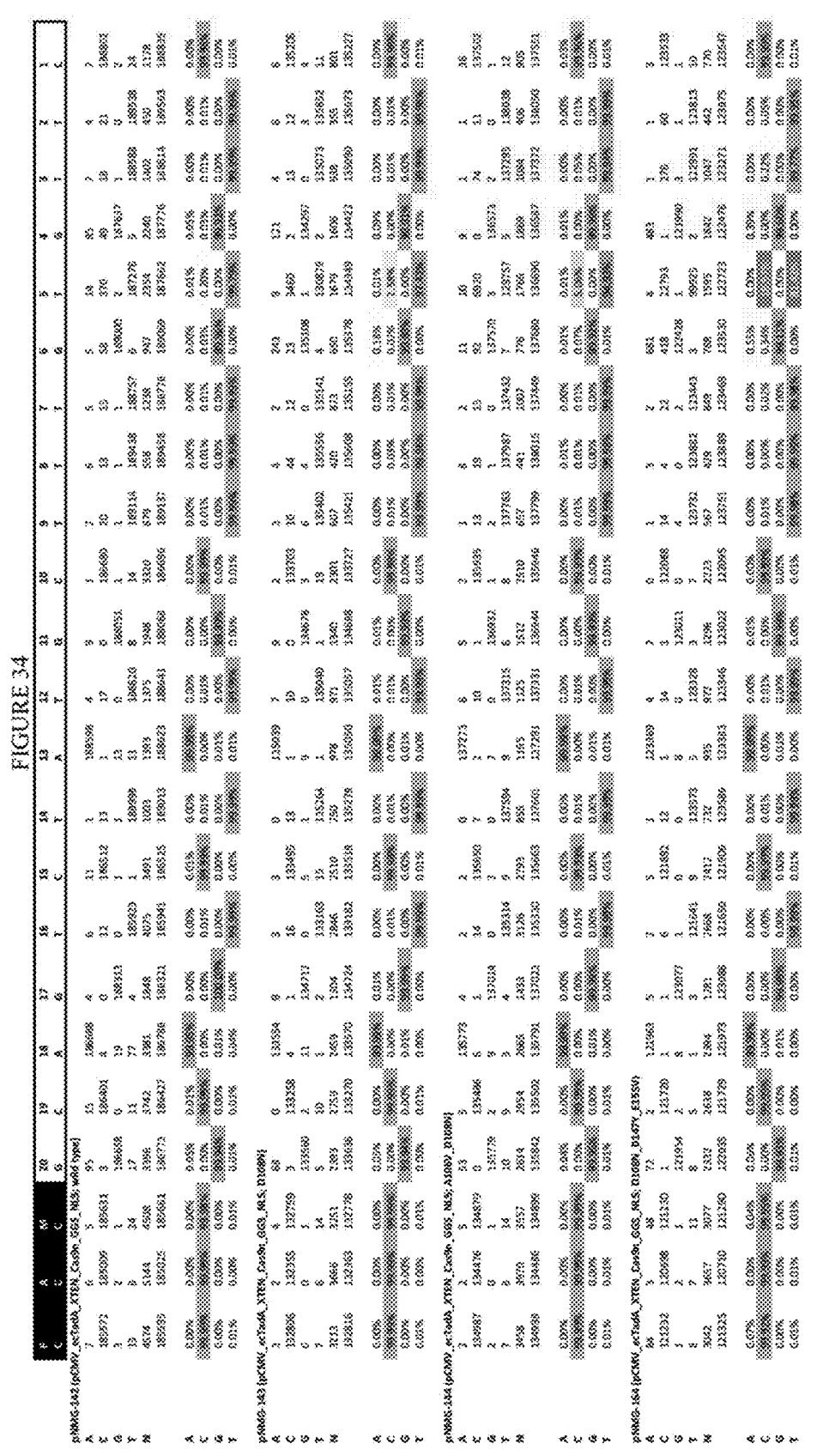
Figure 34:
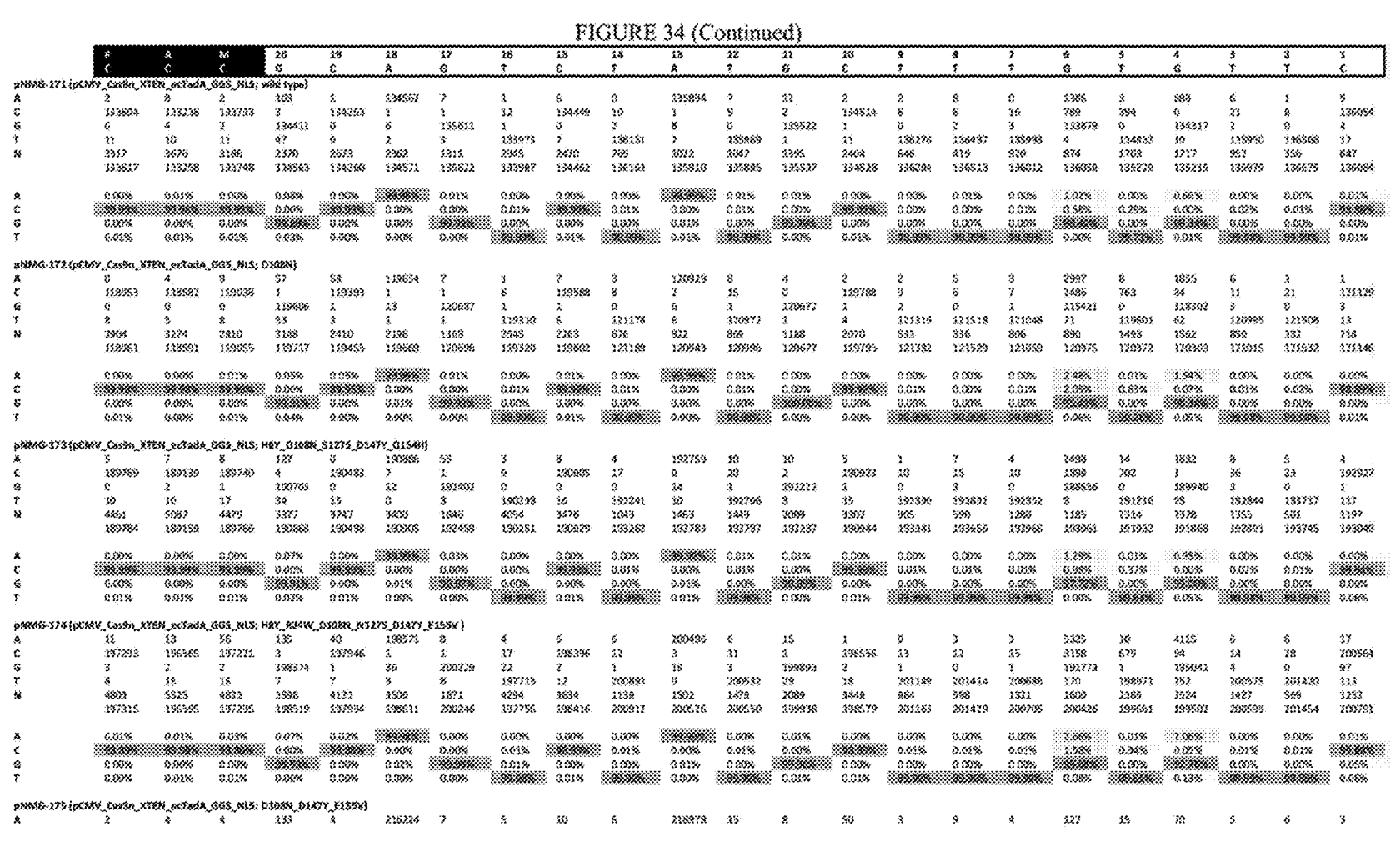
Figure 34:
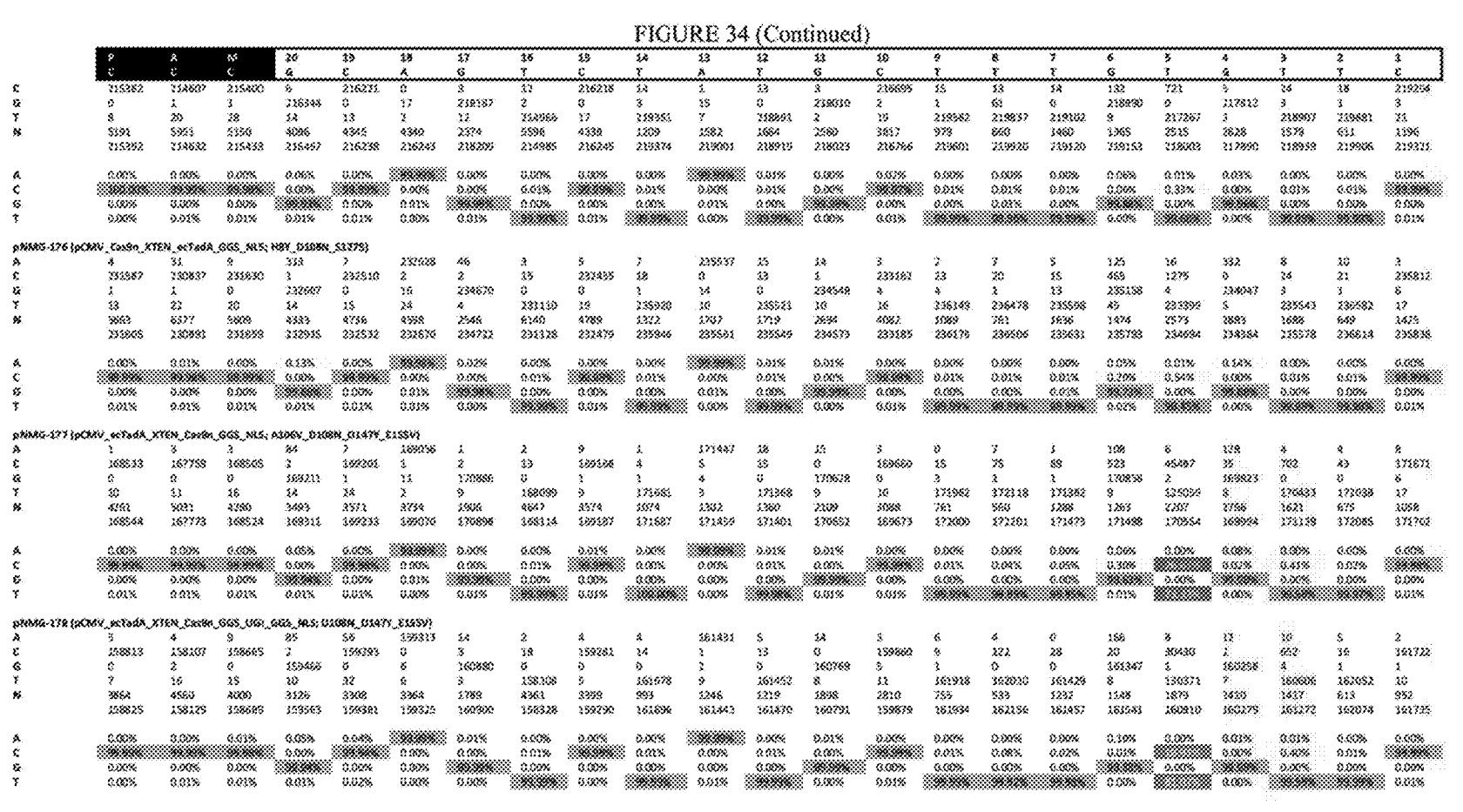
Figure 34:
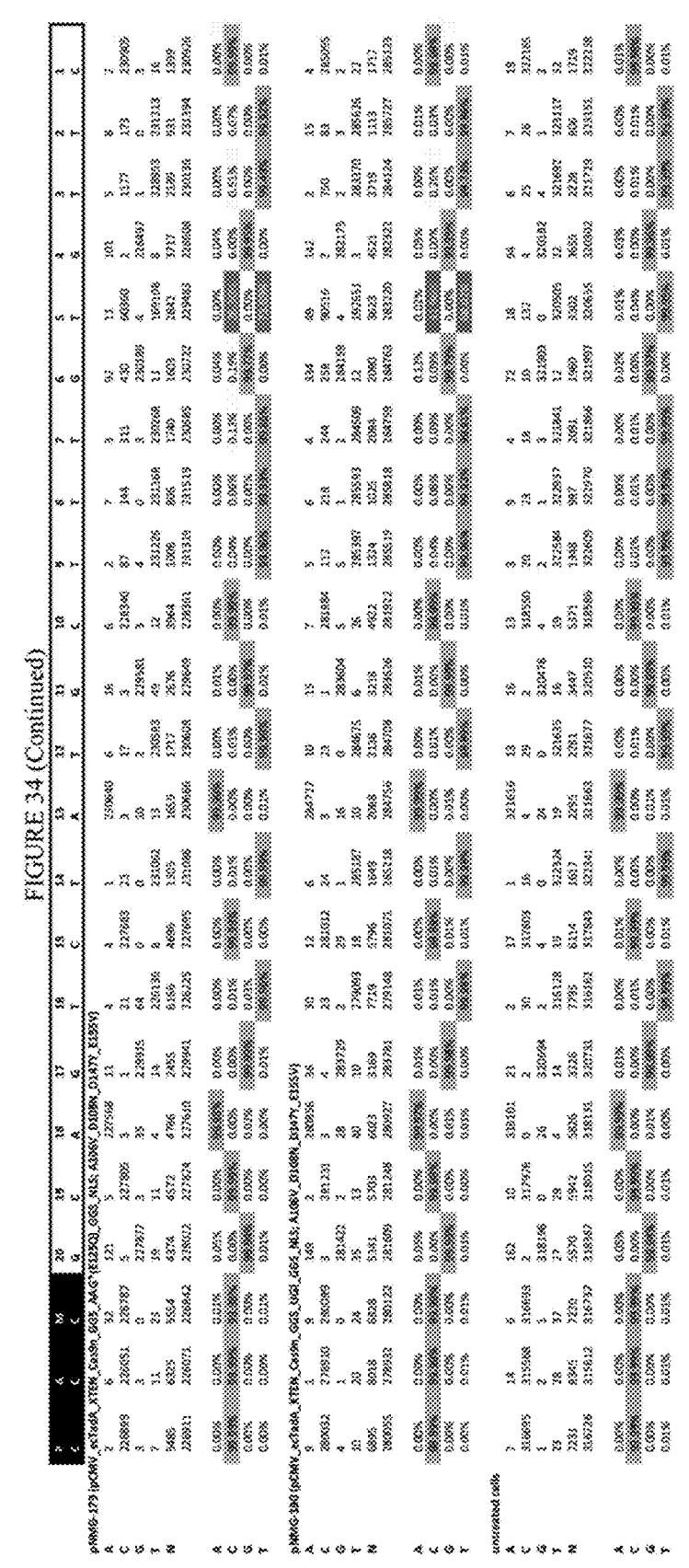

FIG. 34 shows the results of C-terminal fusion at the Hek-2 site. The sequence corresponds to SEQ ID NO: 41.

Figure 35:
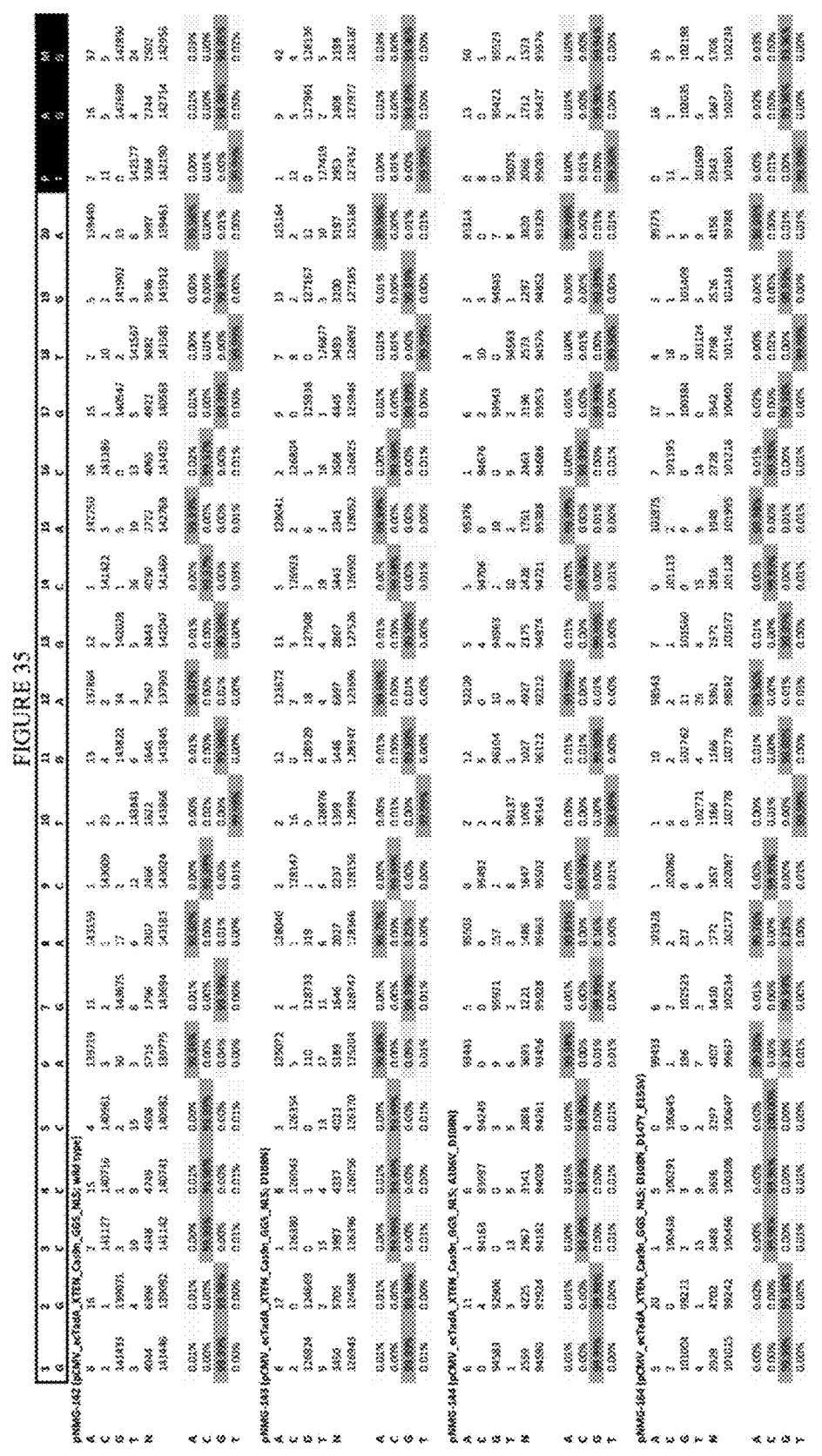
Figure 35:
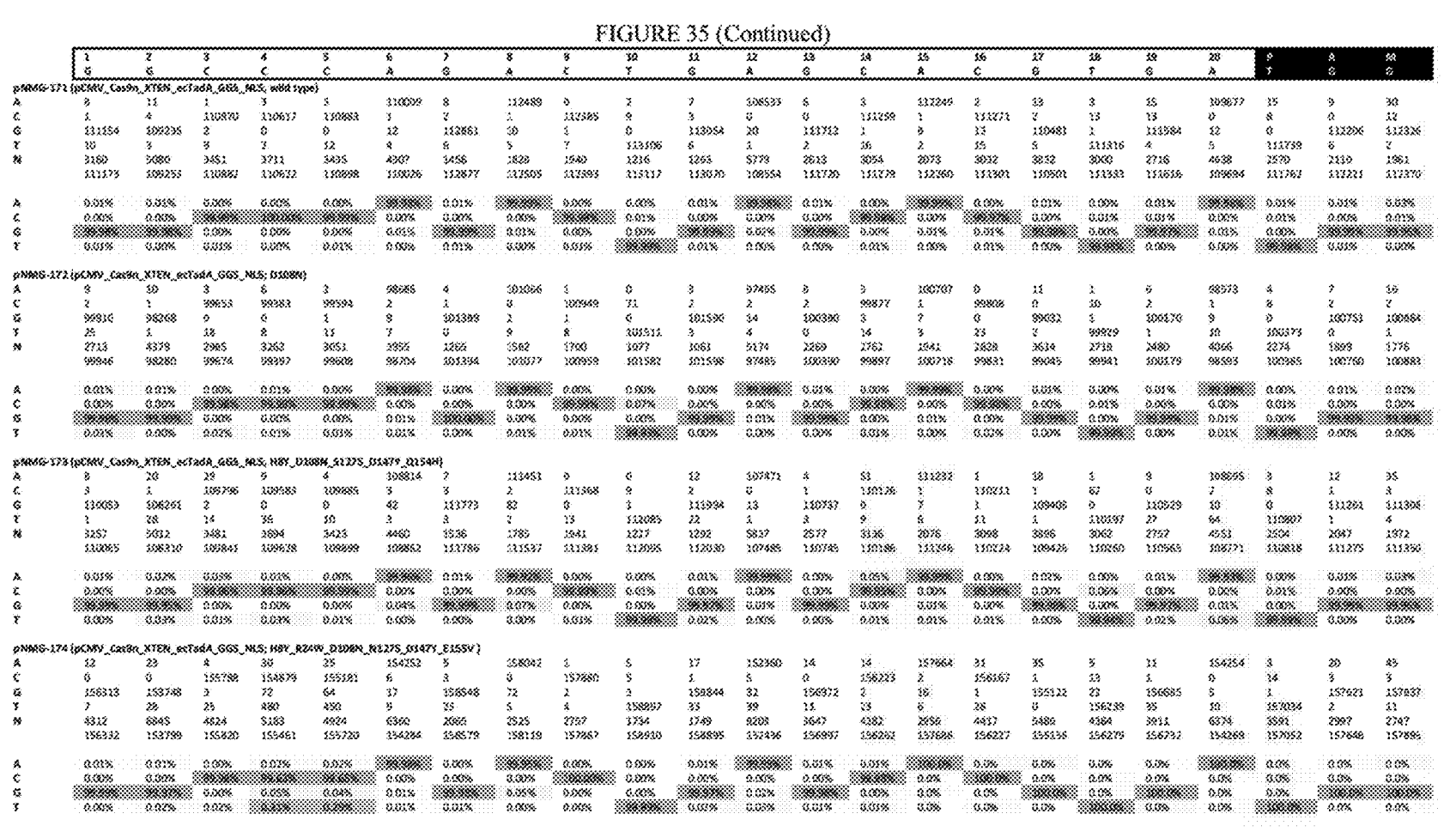
Figure 35:
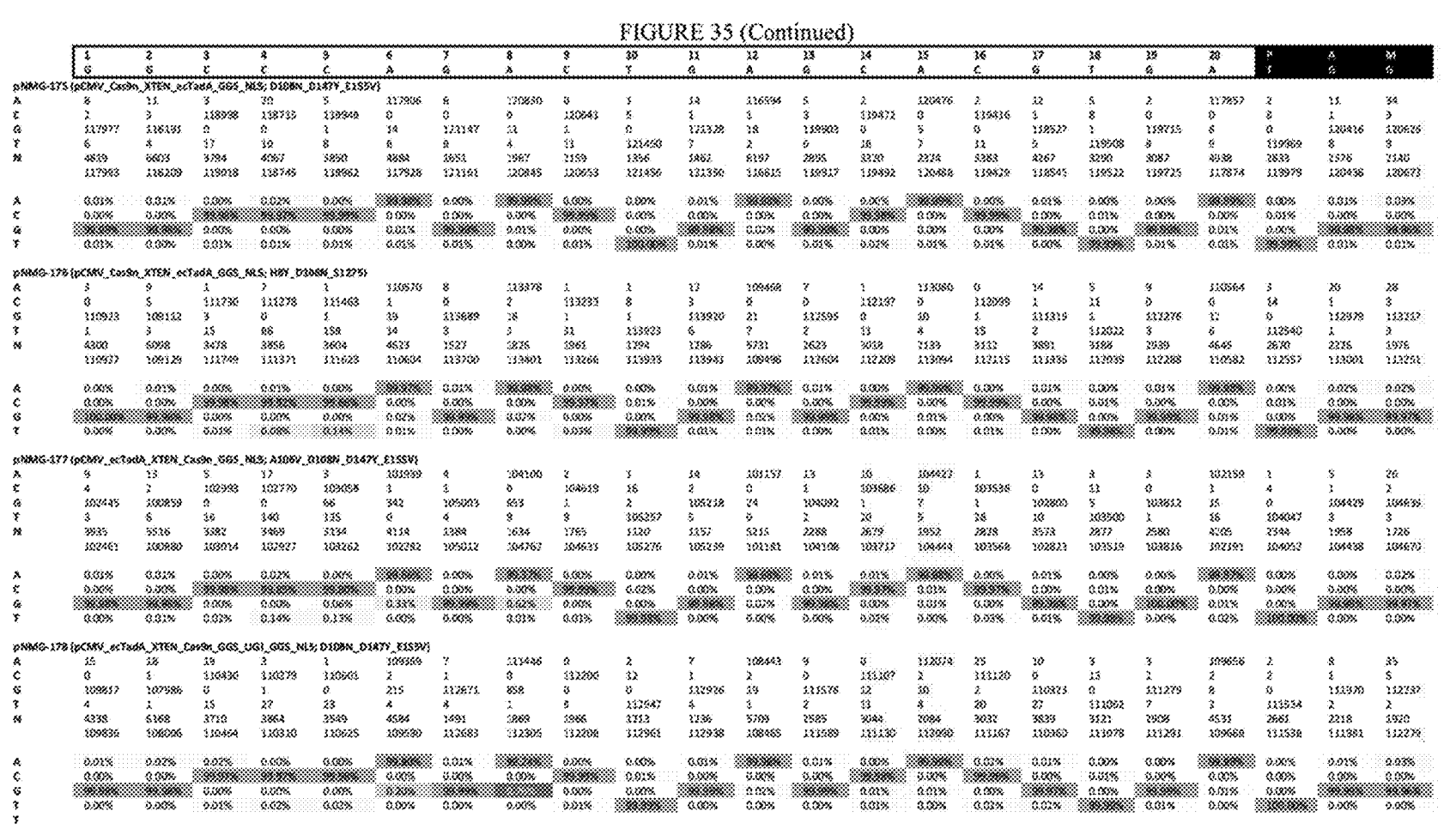
Figure 35:
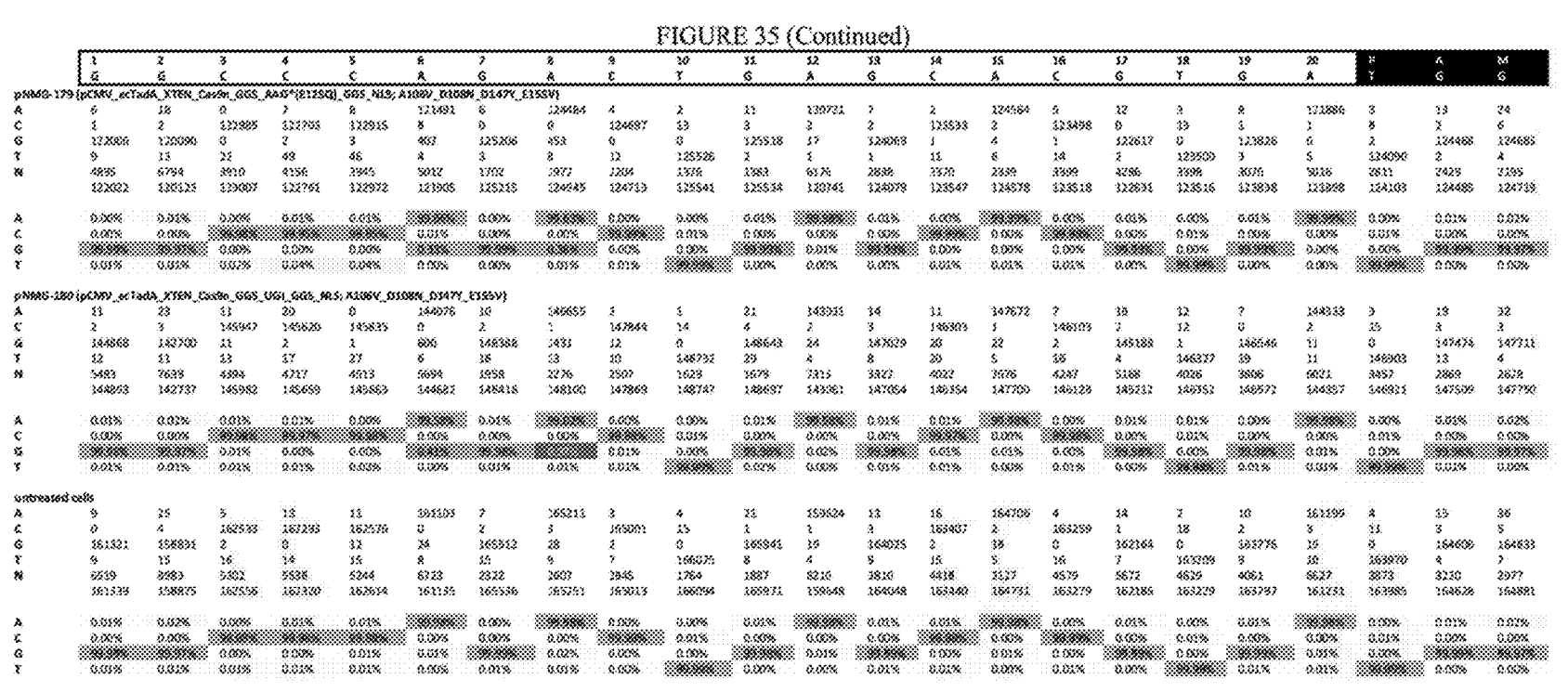

FIG. 35 shows the results of C-terminal fusion at the Hek-3 site. The sequence corresponds to SEQ ID NO: 42.

Figure 36:
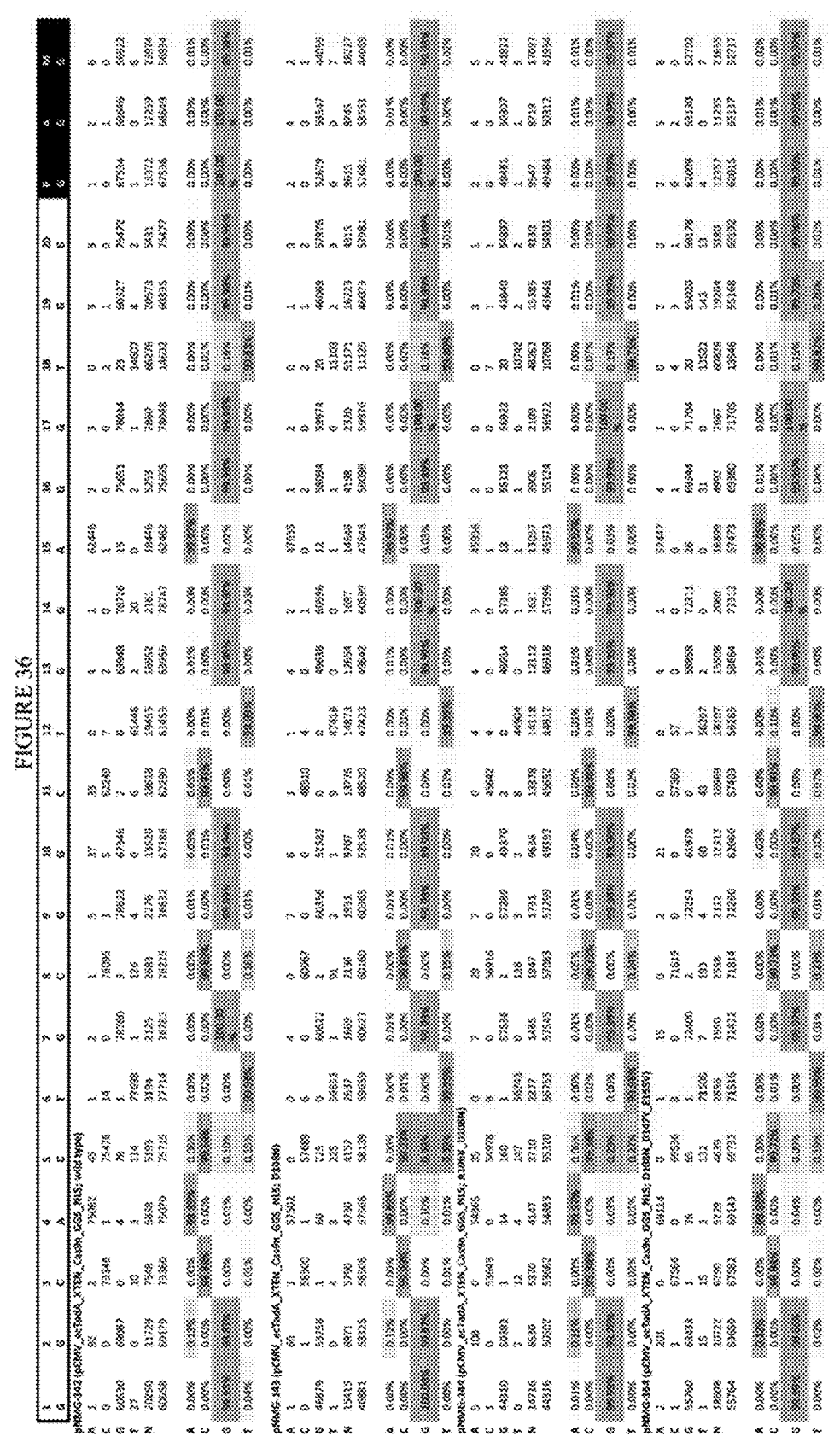
Figure 36:
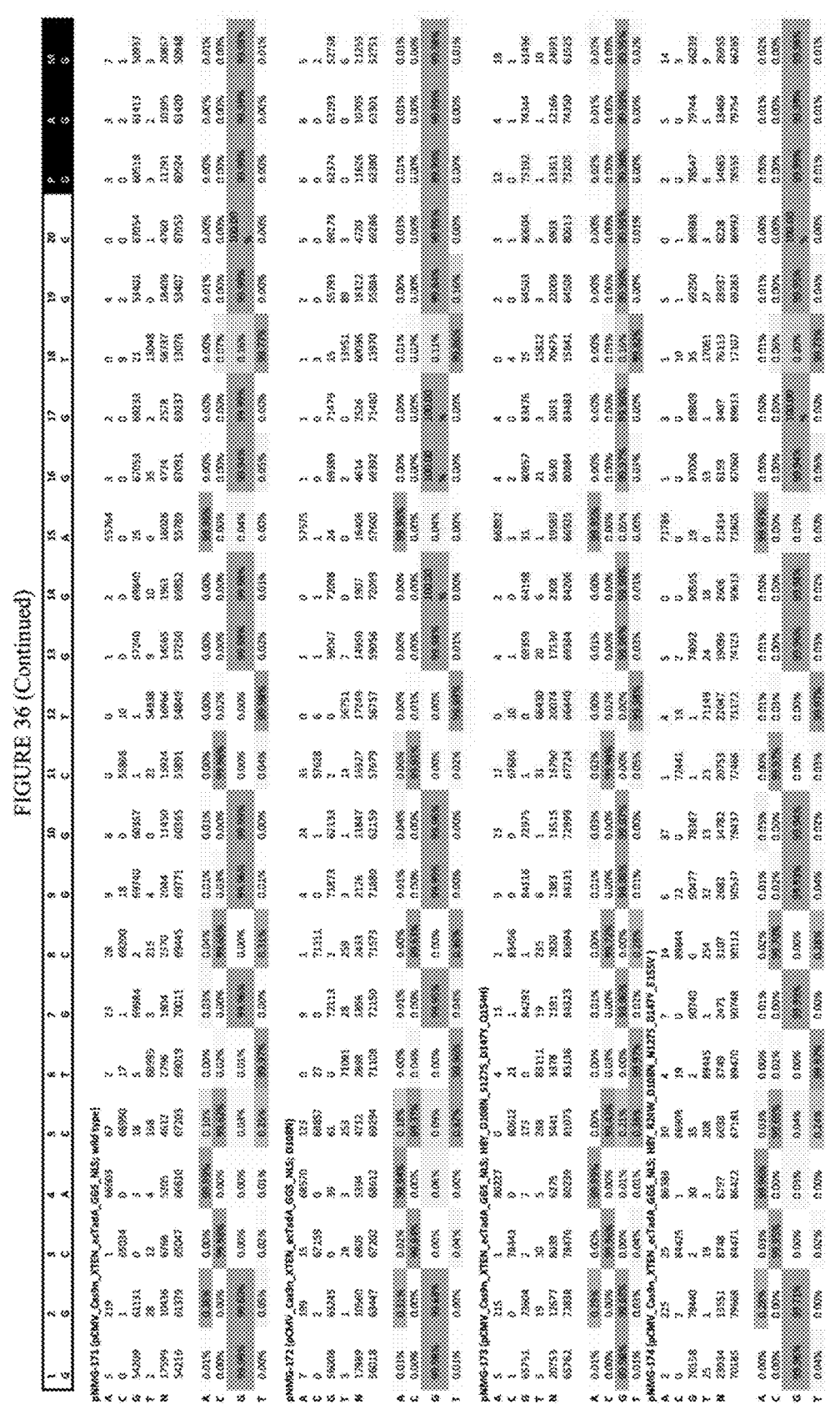
Figure 36:
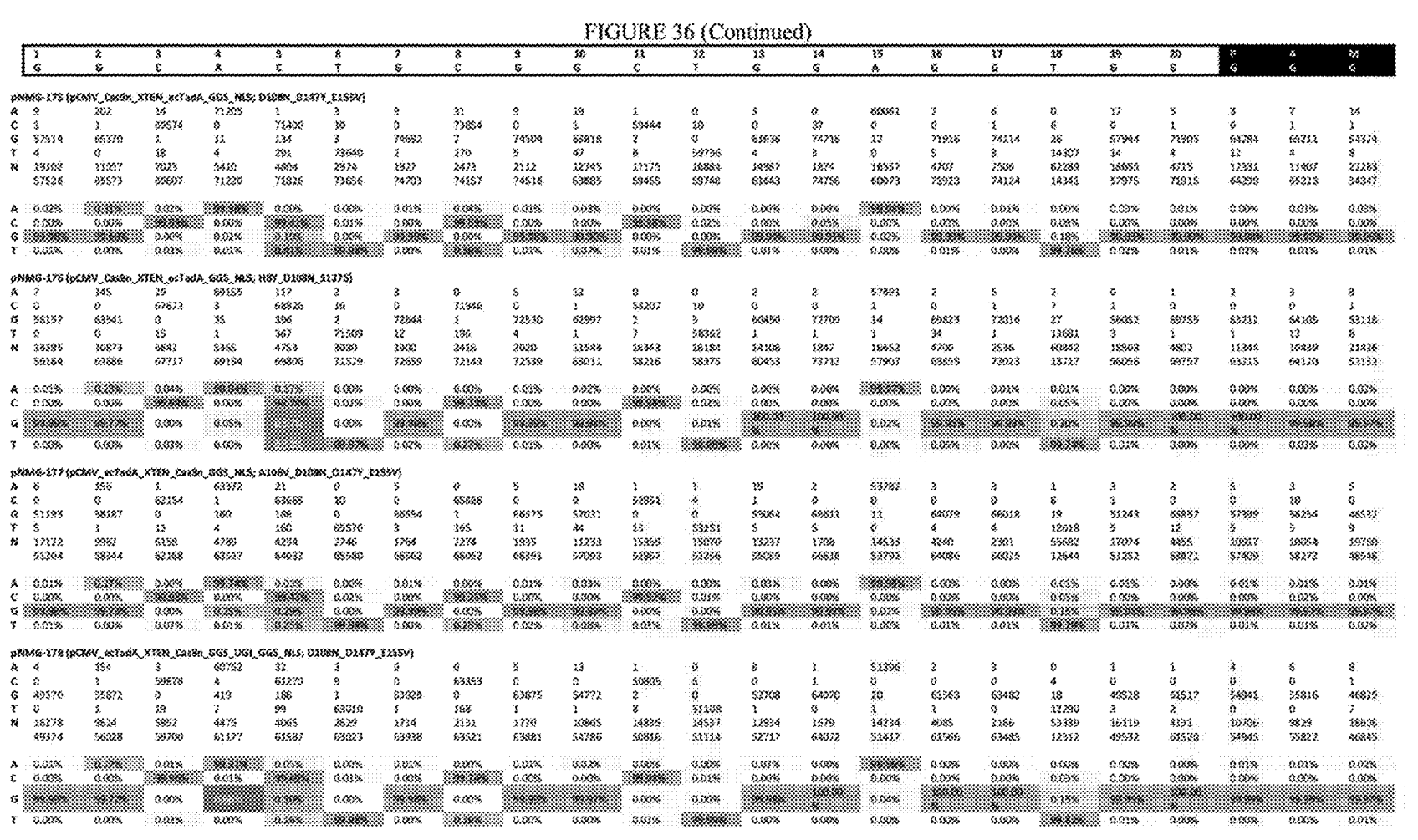
Figure 36:
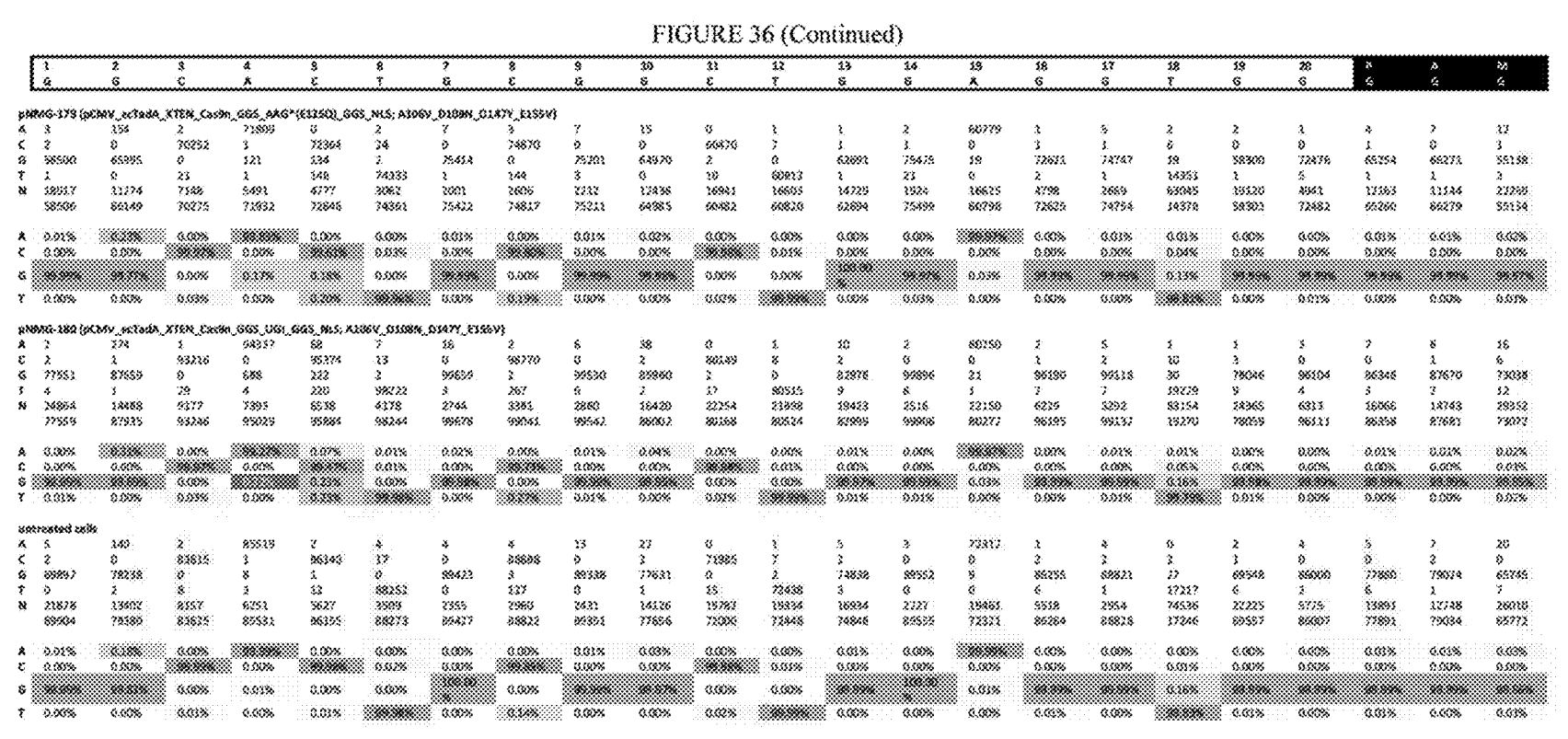

FIG. 36 shows the results of C-terminal fusion at the Hek-4 site. The sequence corresponds to SEQ ID NO: 43.

Figure 37:
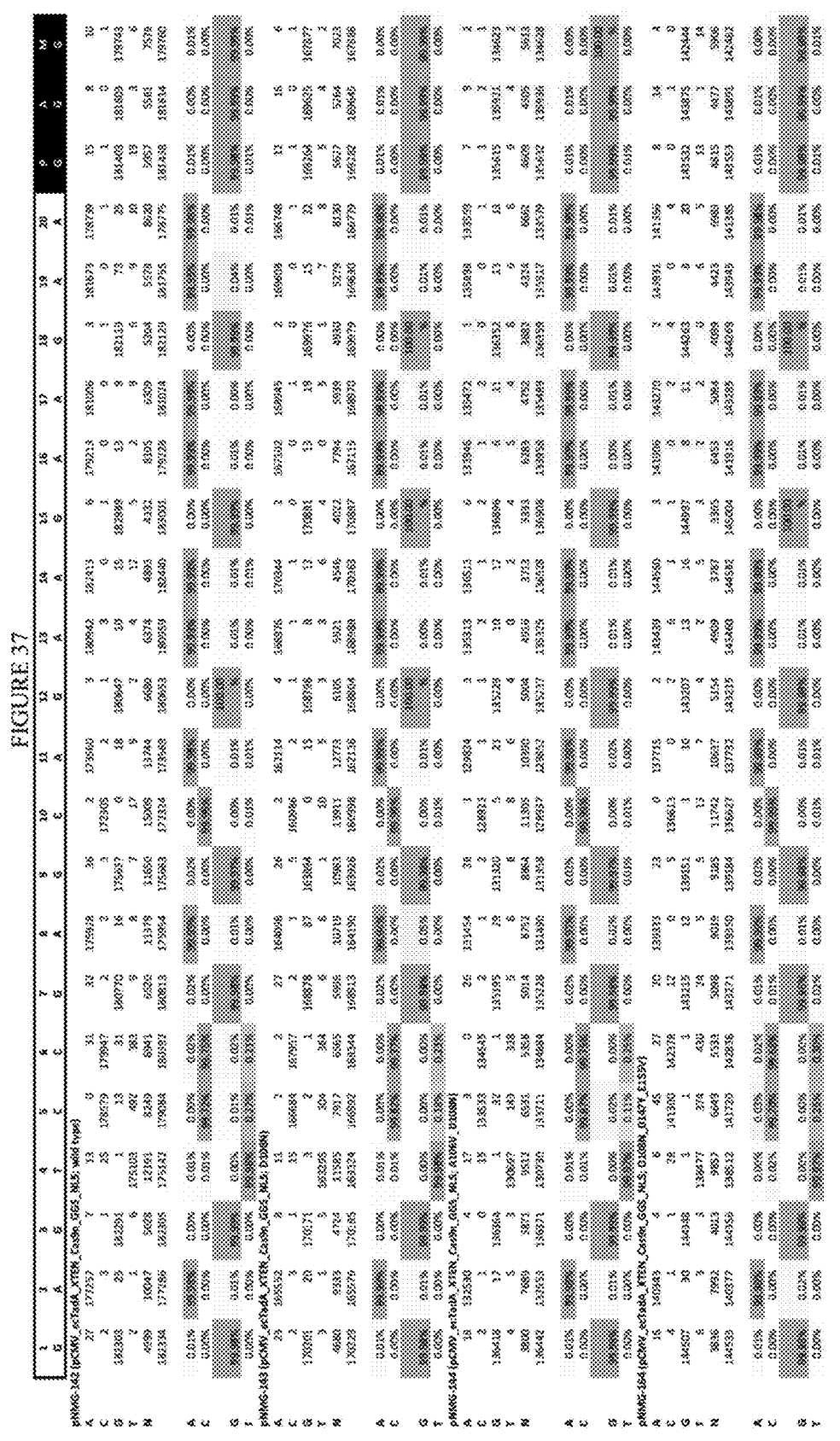
Figure 37:
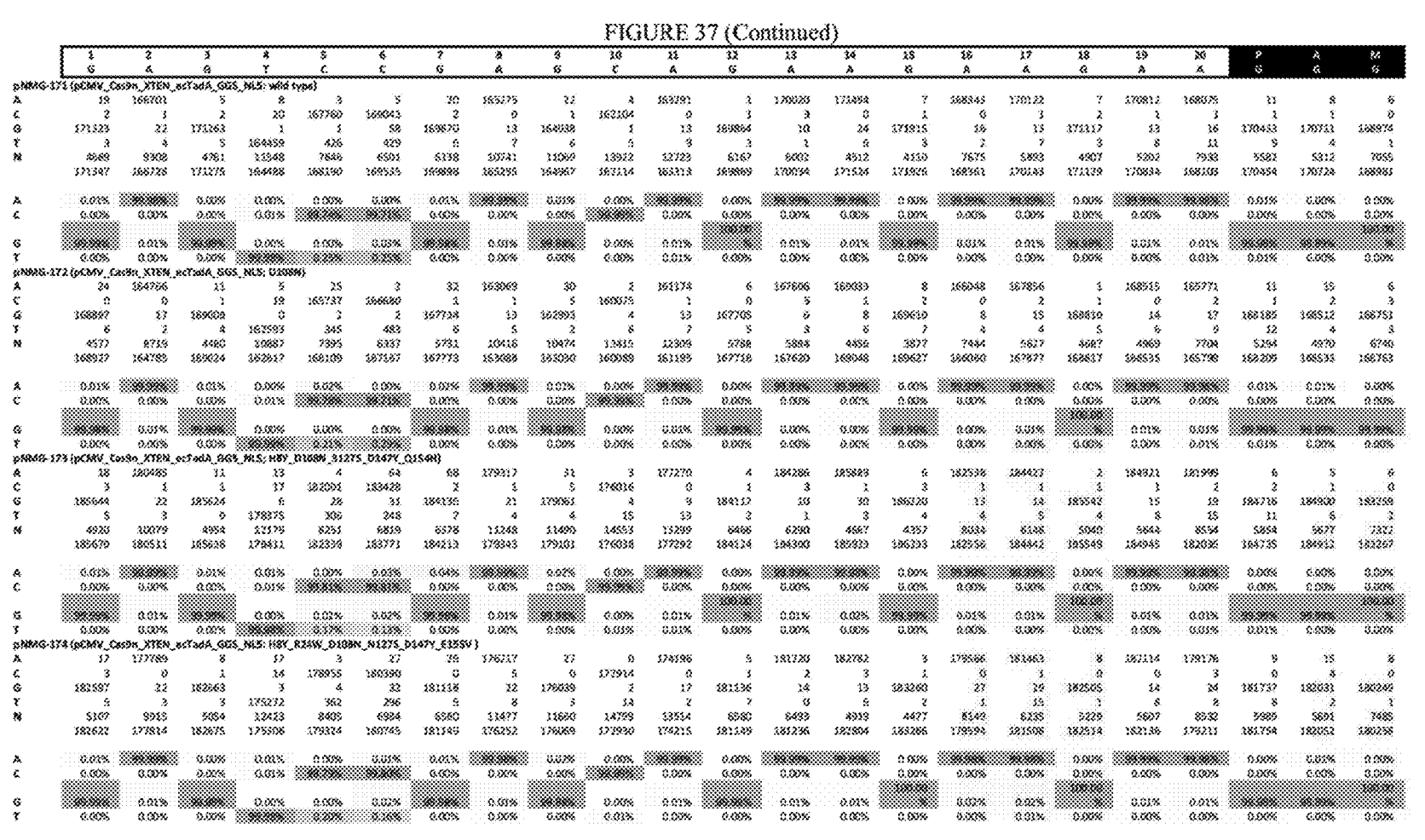
Figure 37:
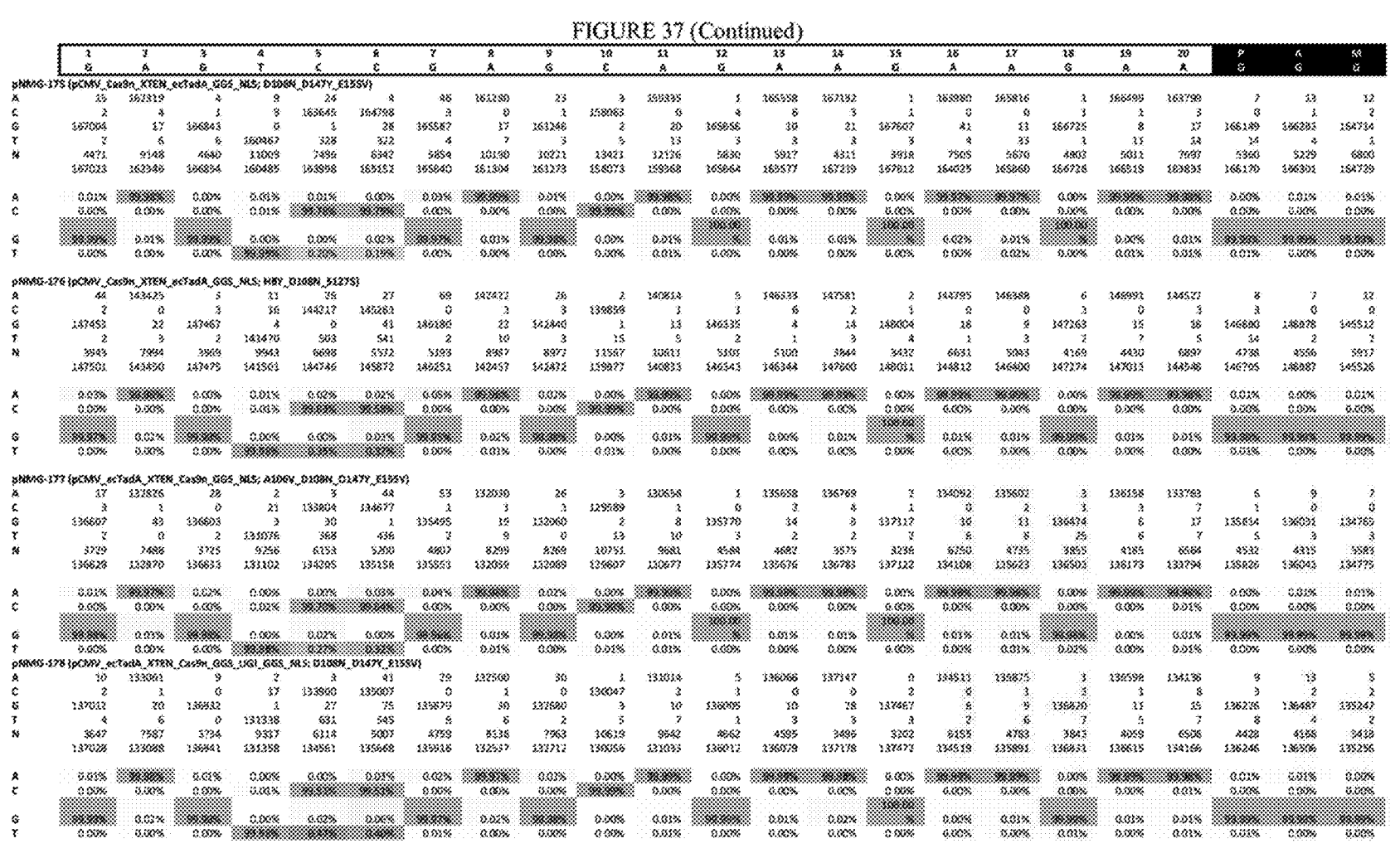
Figure 37:
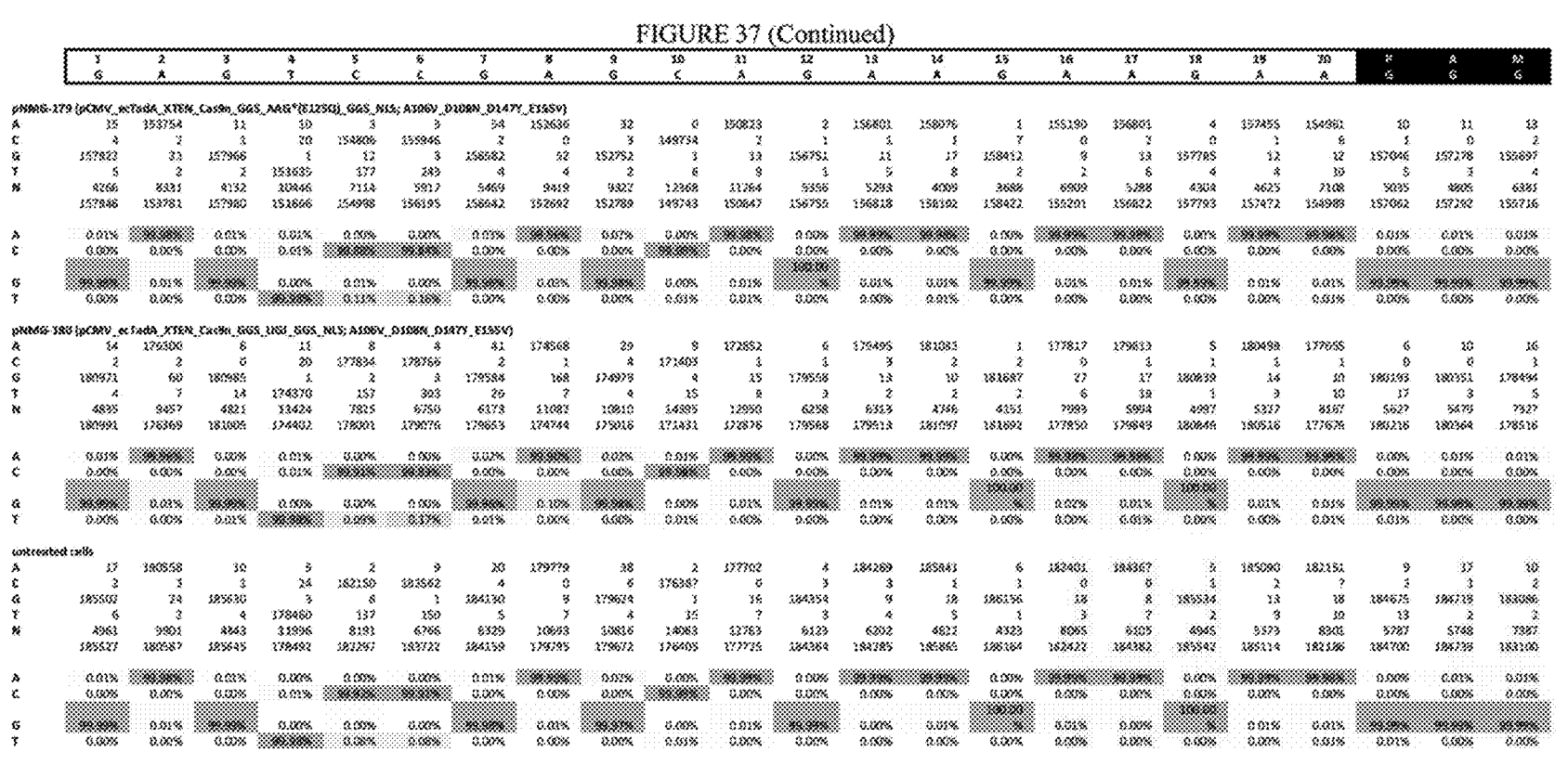

FIG. 37 shows the results of C-terminal fusion at the EMX-1 site. The sequence corresponds to SEQ ID NO: 46.

Figure 38:
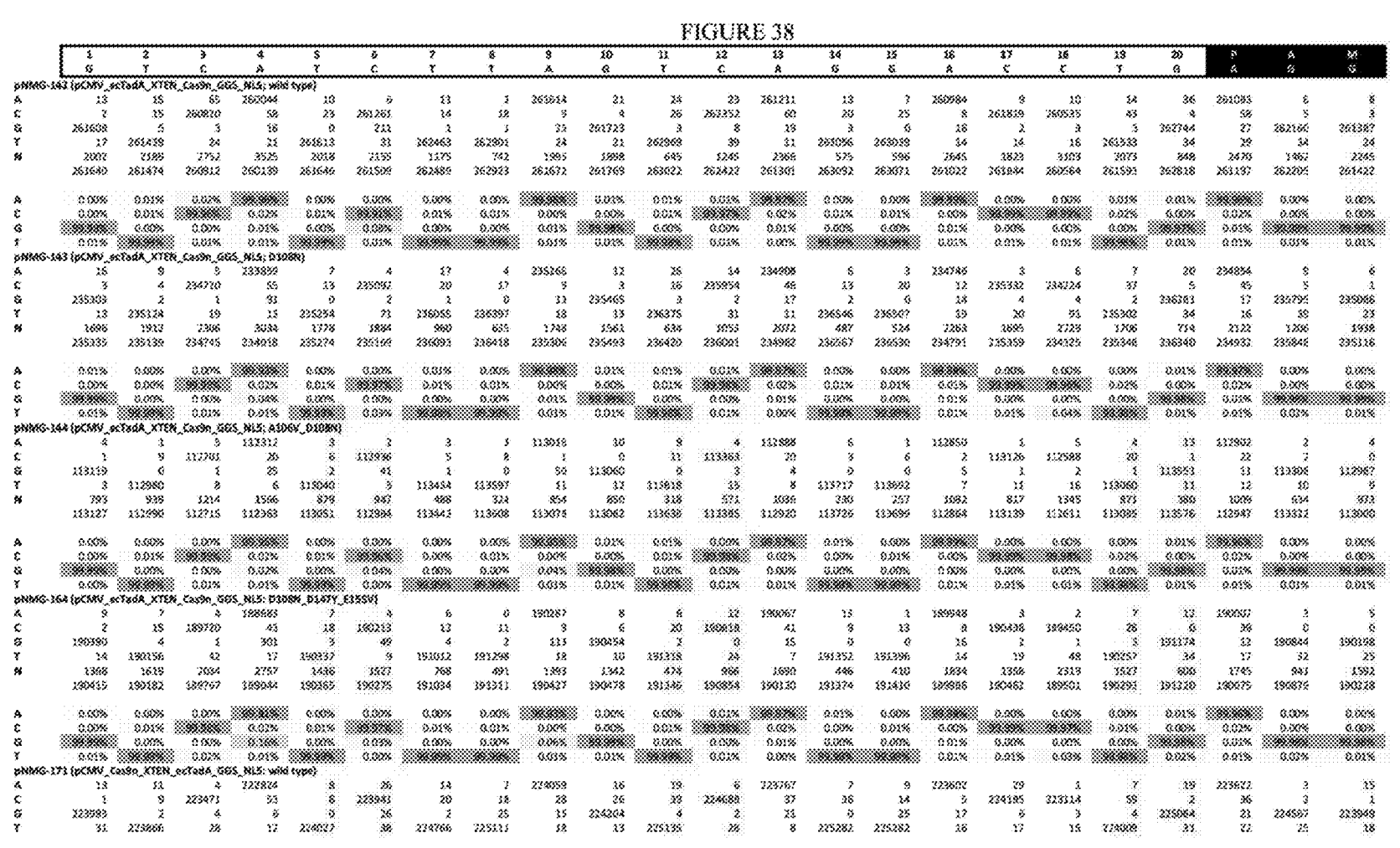
Figure 38:
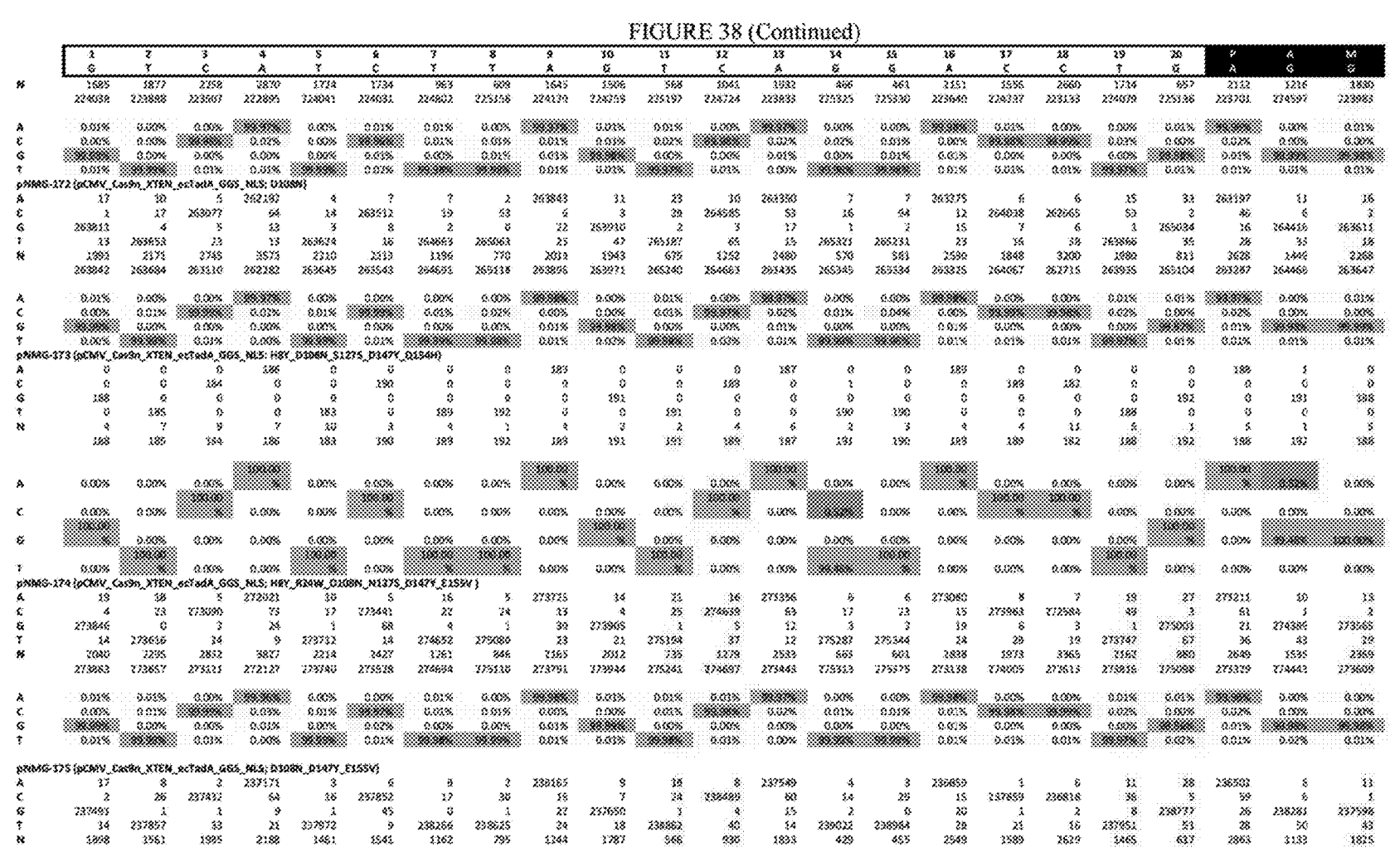
Figure 38:
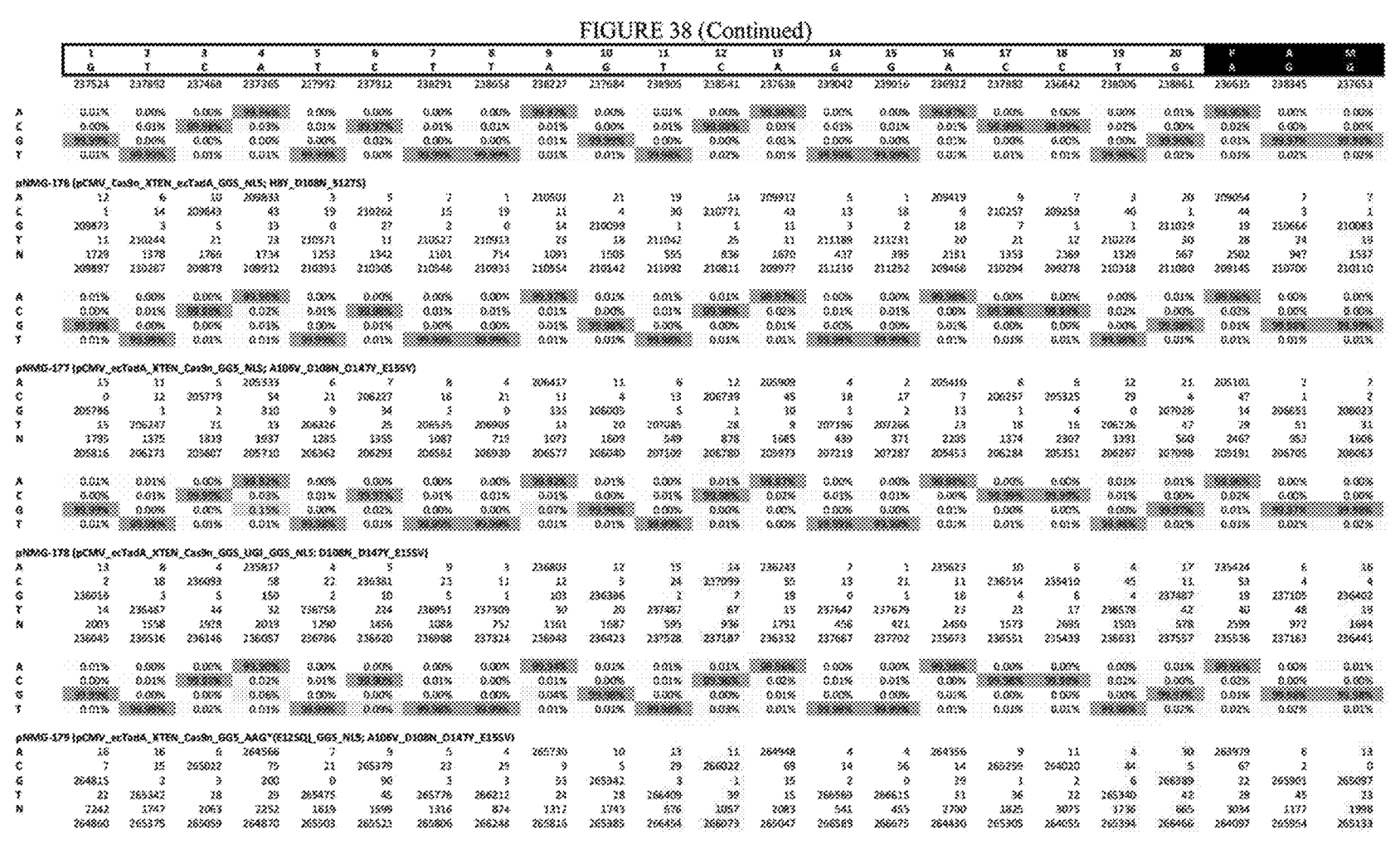
Figure 38:
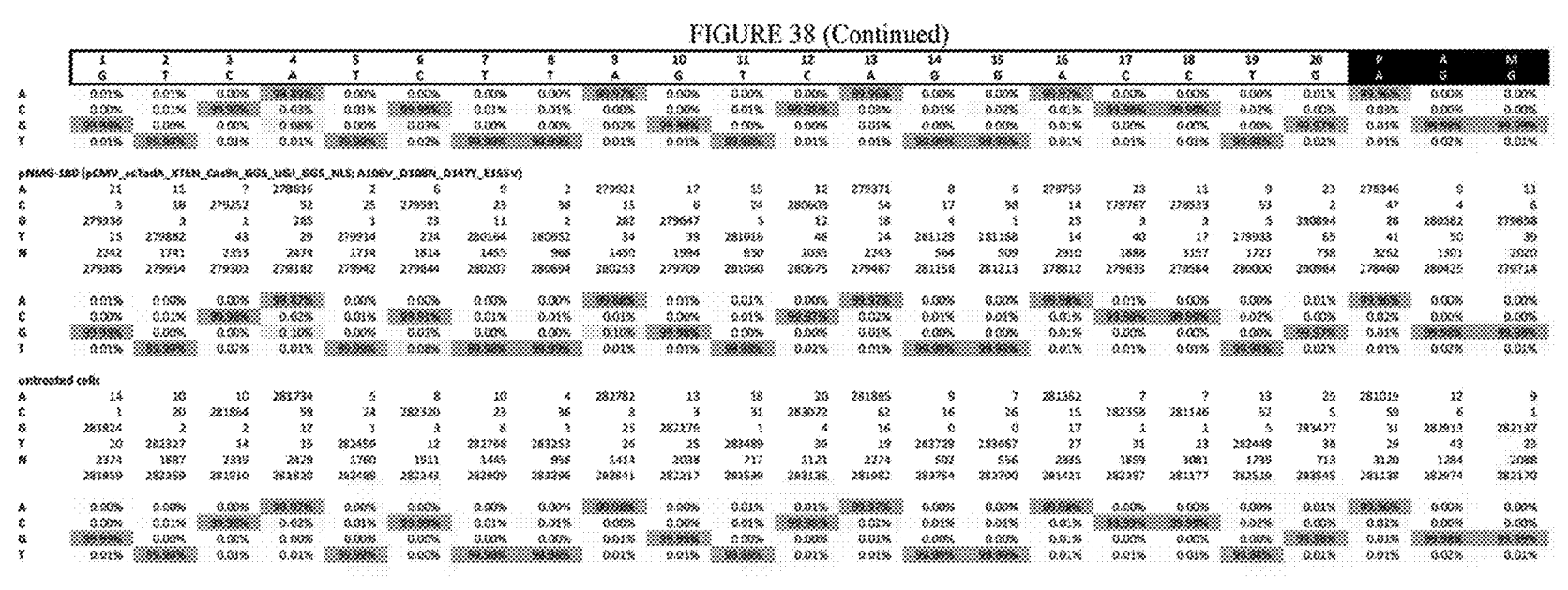

FIG. 38 shows the results of C-terminal fusion at the RNF-2 site. The sequence corresponds to SEQ ID NO: 44.

Figure 39:
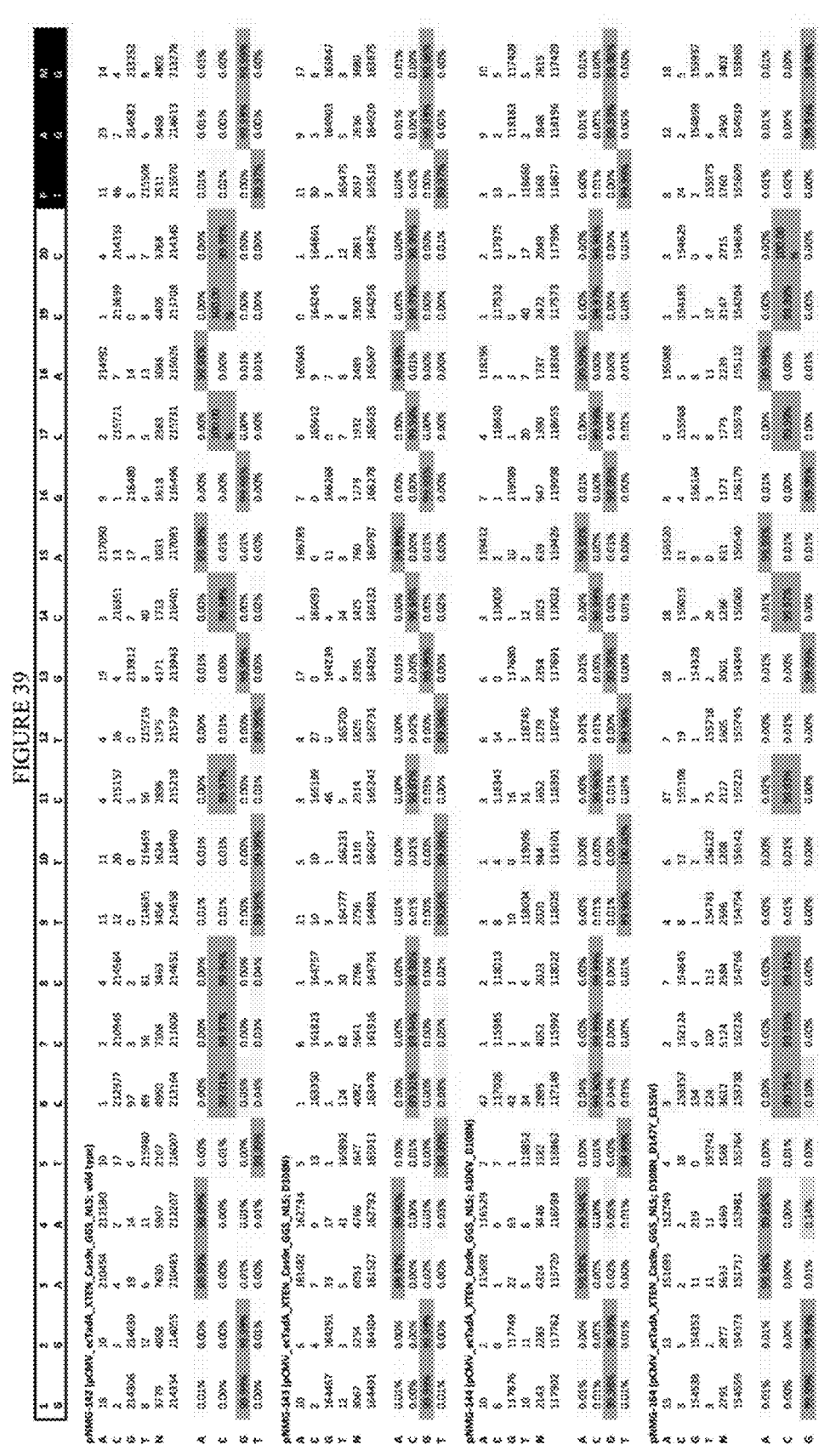
Figure 39:
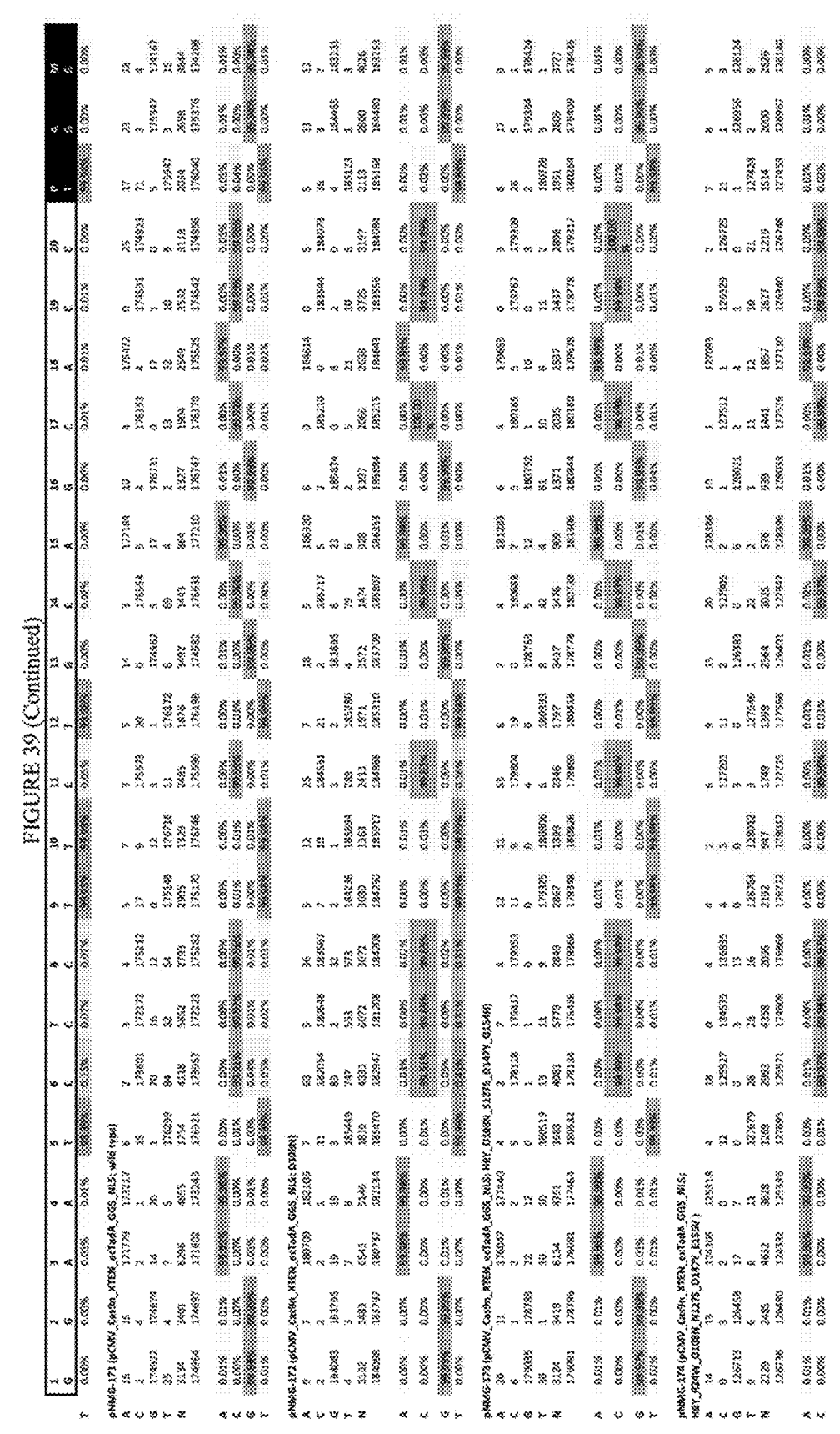
Figure 39:
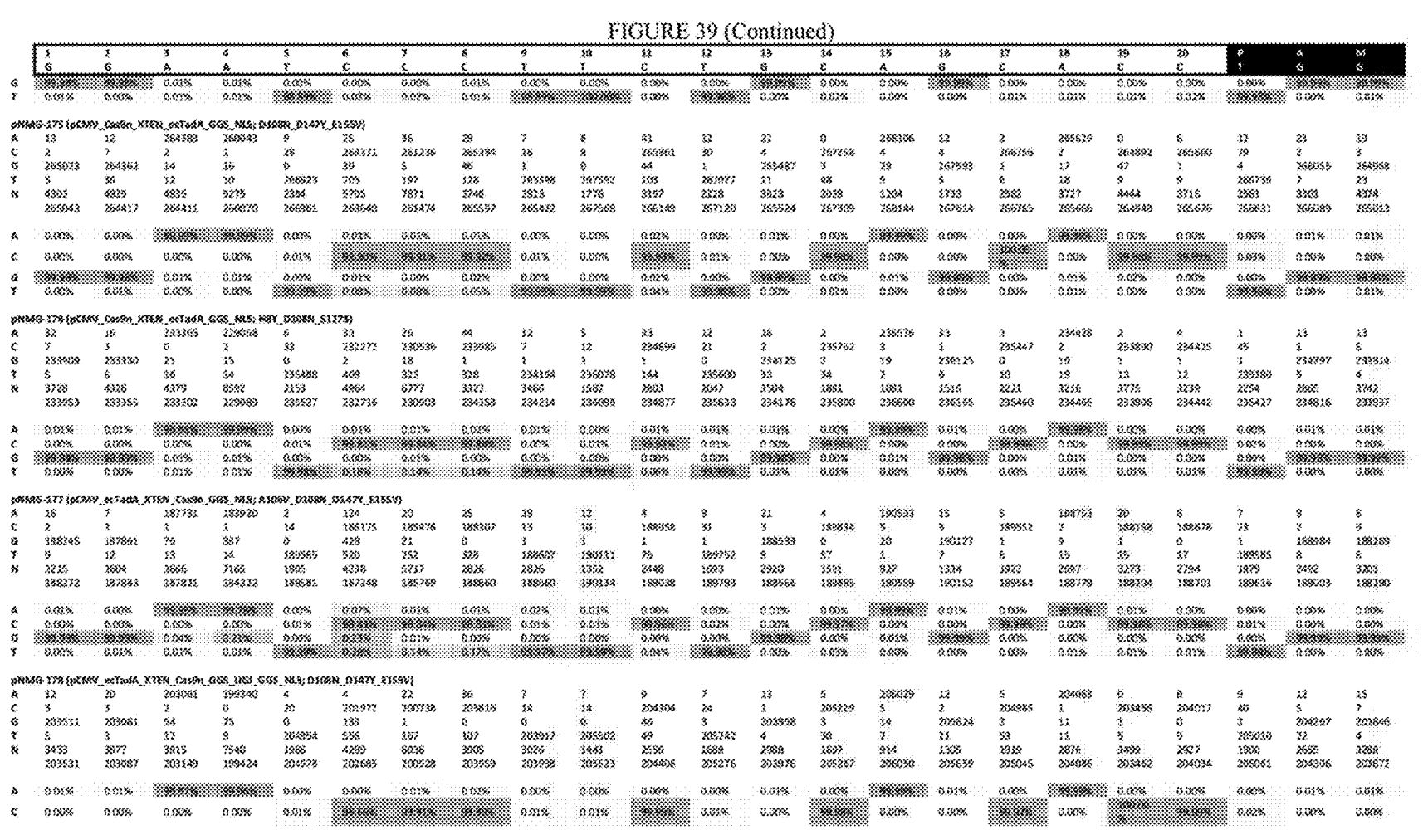
Figure 39:
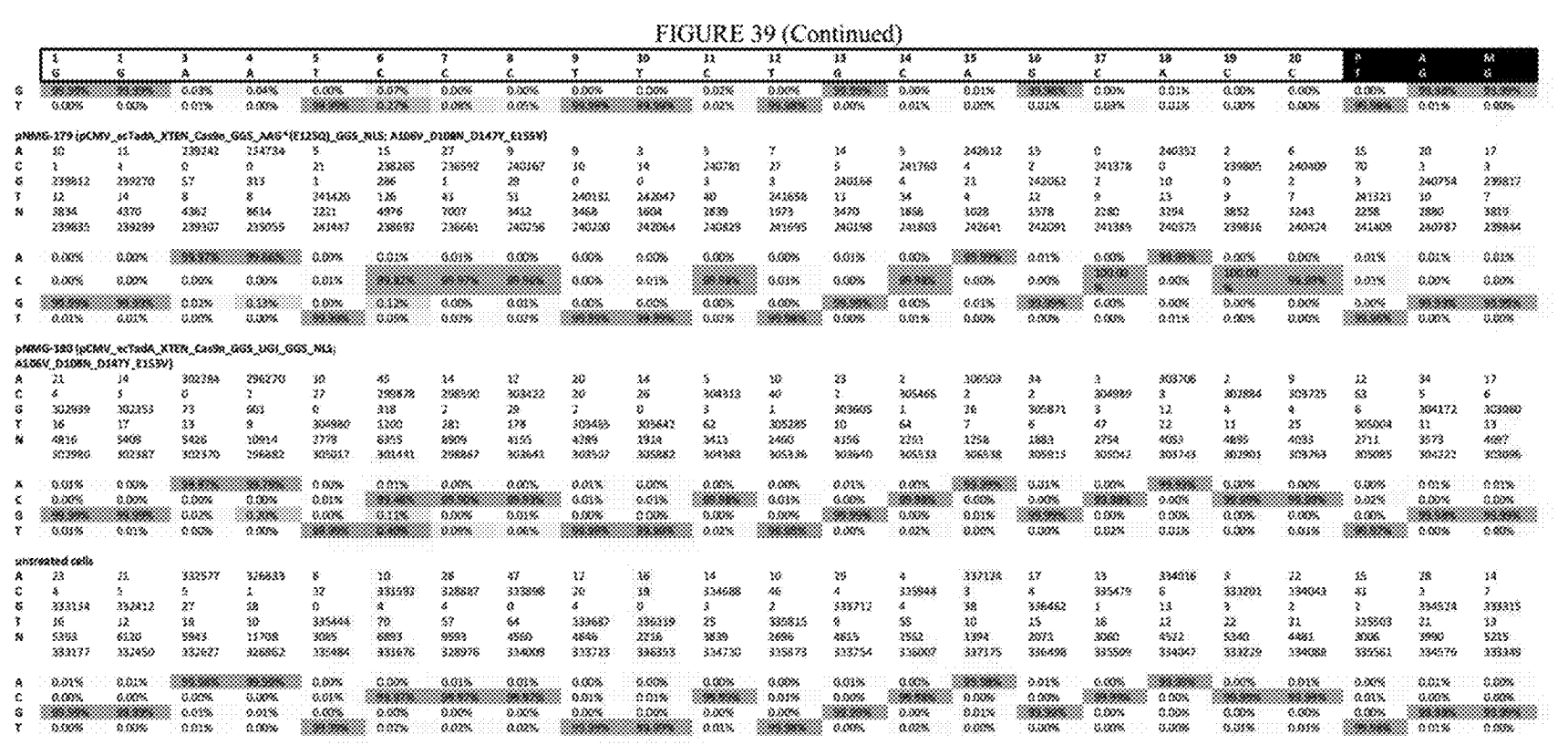

FIG. 39 shows the results of C-terminal fusion at the FANCF site. The sequence corresponds to SEQ ID NO: 45.

FIG. 40 shows the results of transfection at the Hek-2 site. The sequence corresponds to SEQ ID NO: 41.

Figure 41:
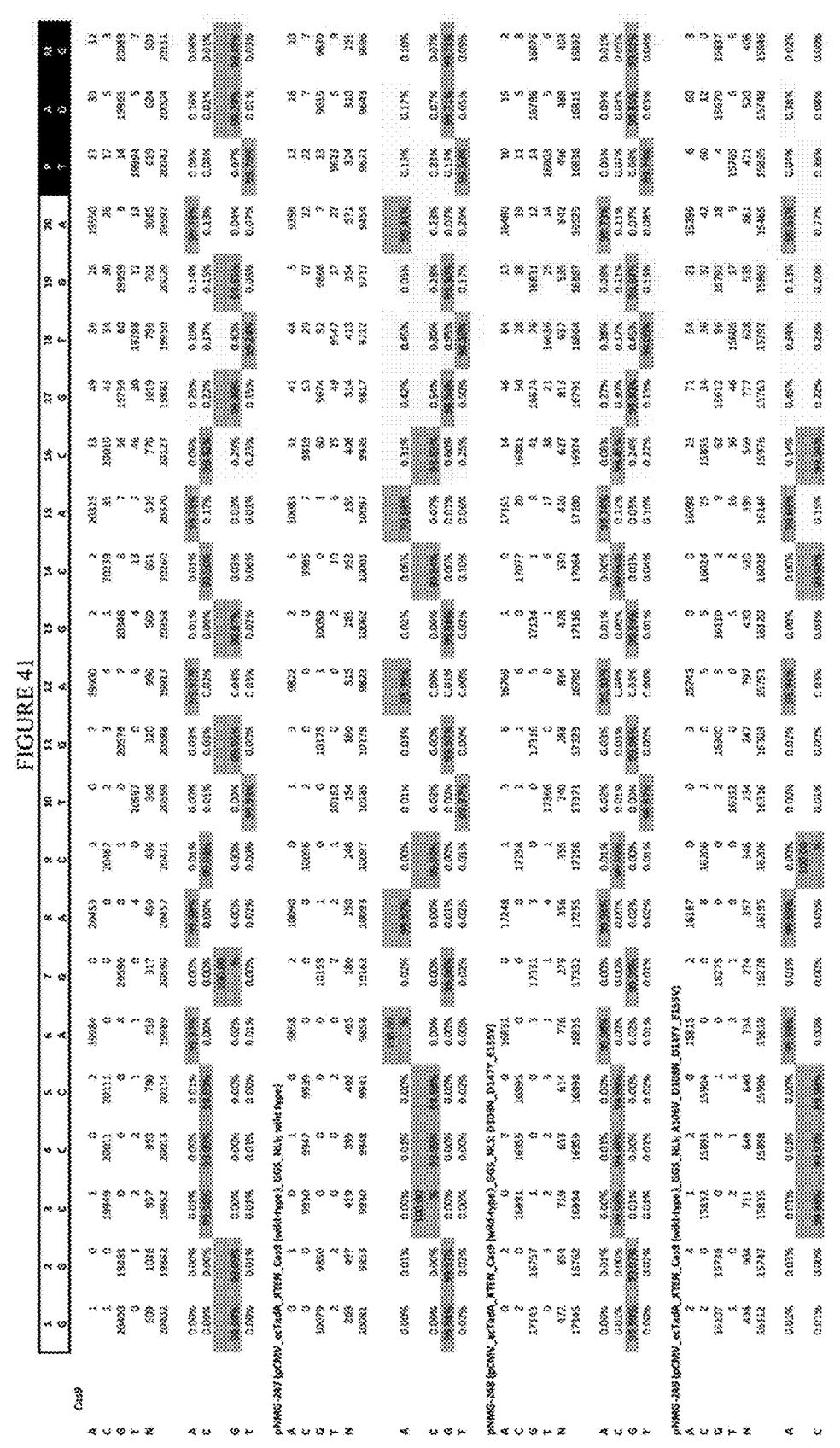
Figure 41:
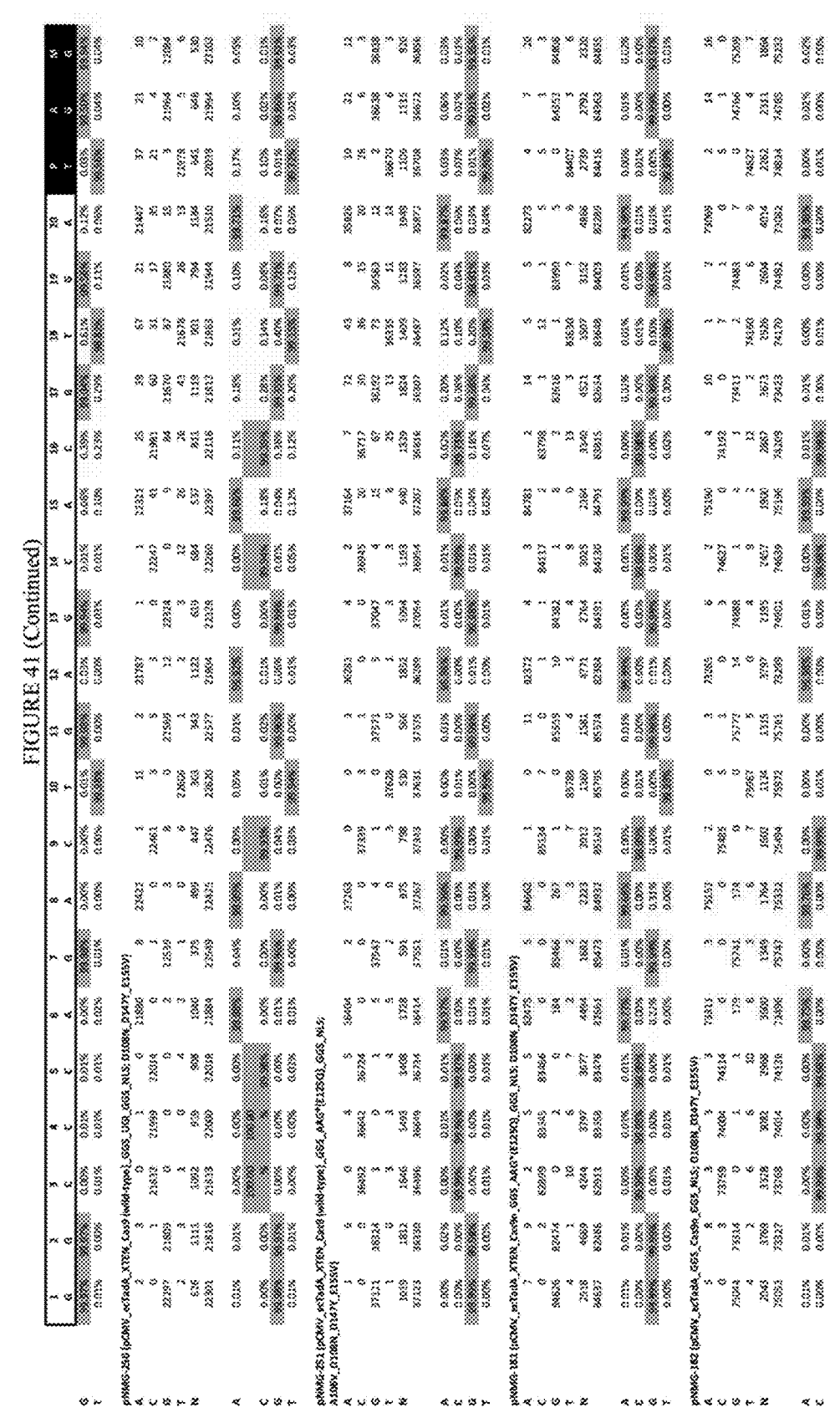
Figure 41:
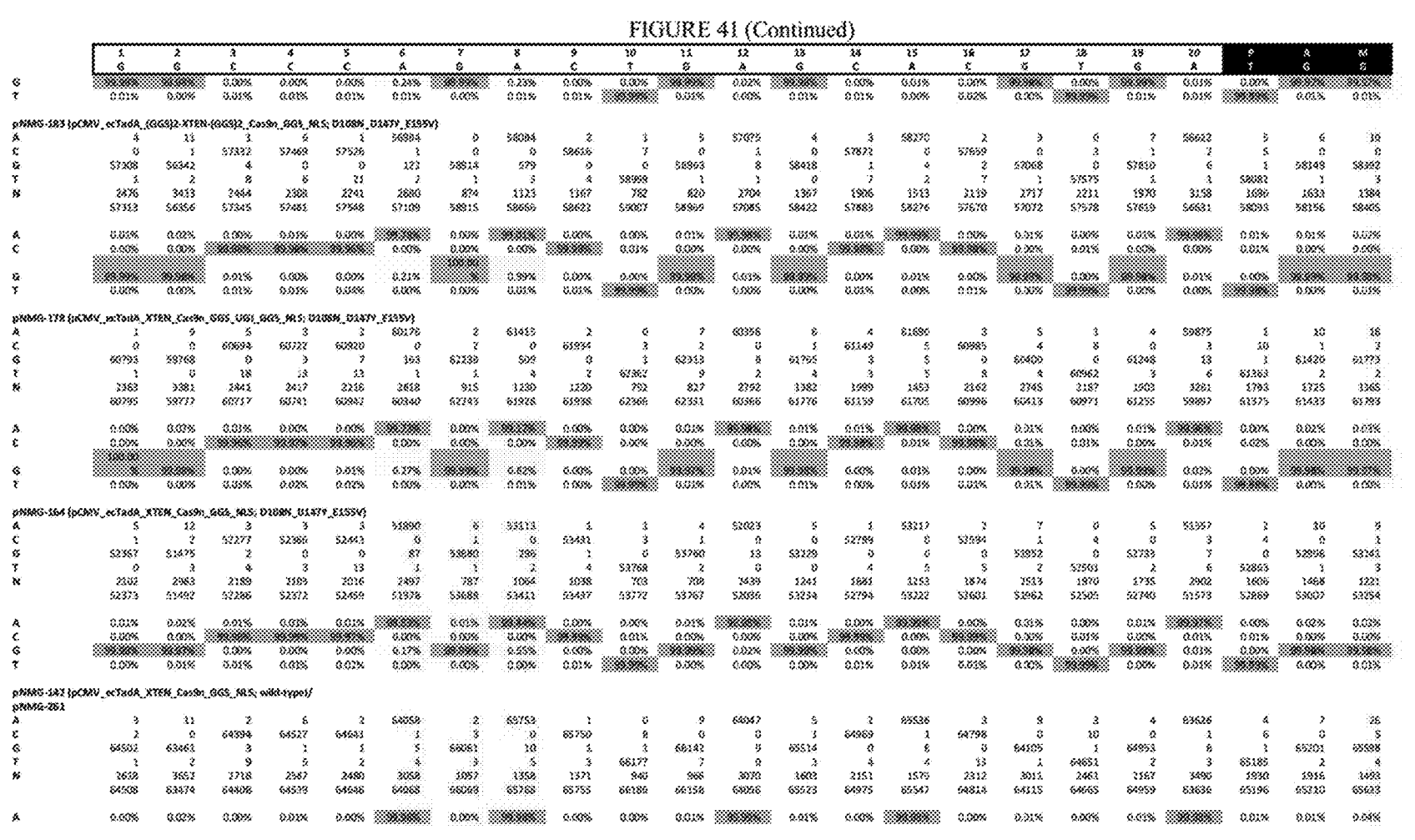
Figure 41:
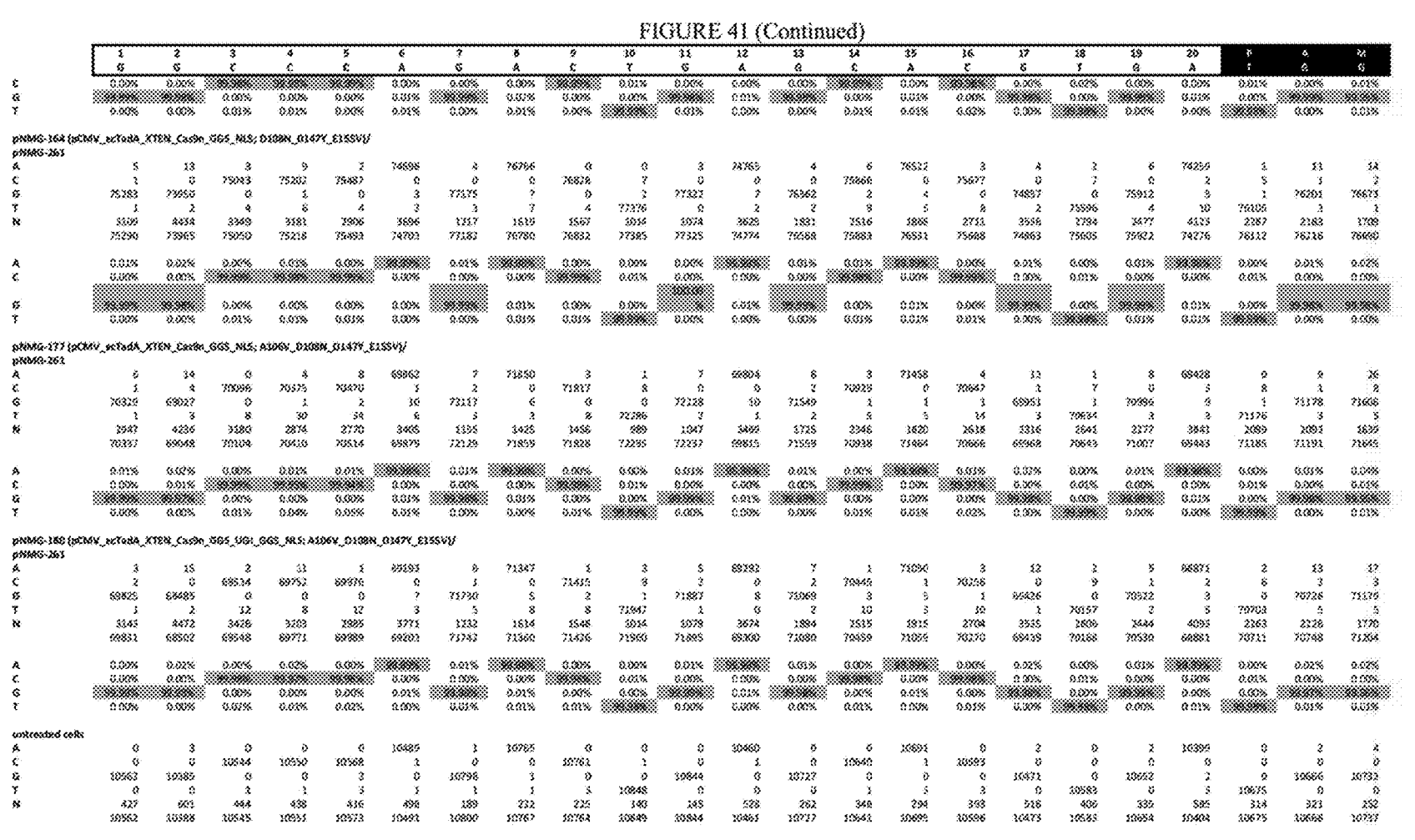
Figure 41:
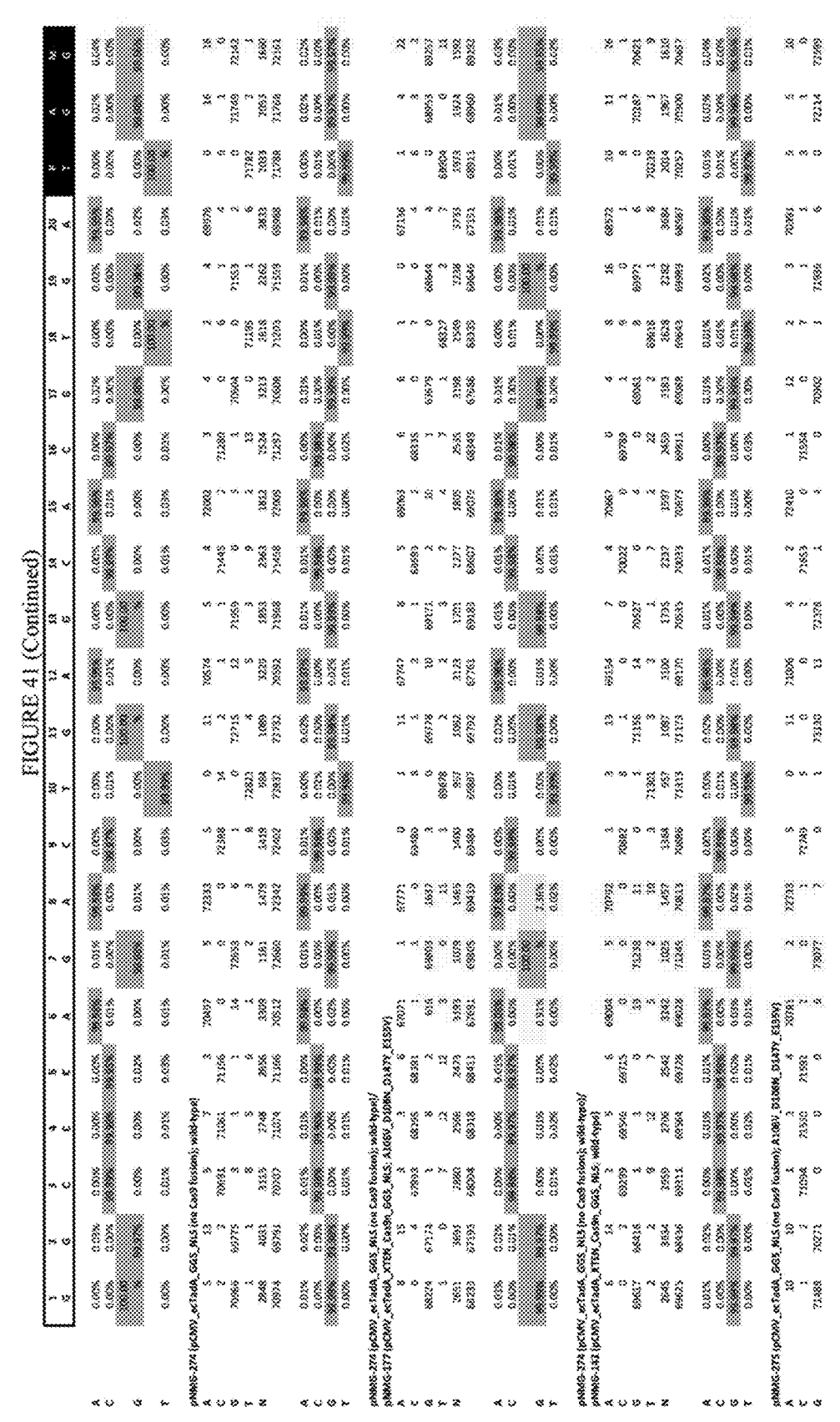
Figure 41:
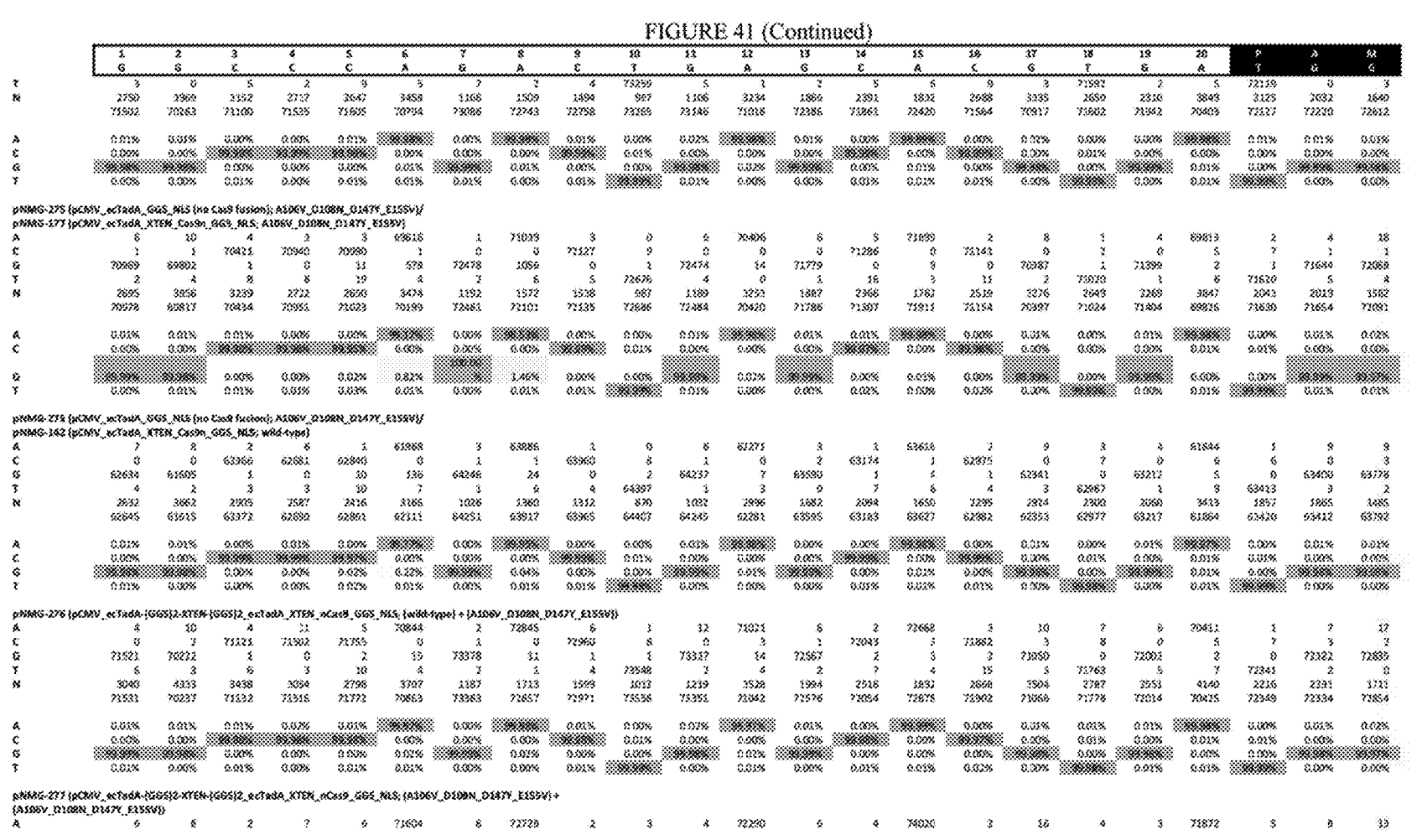
Figure 41:
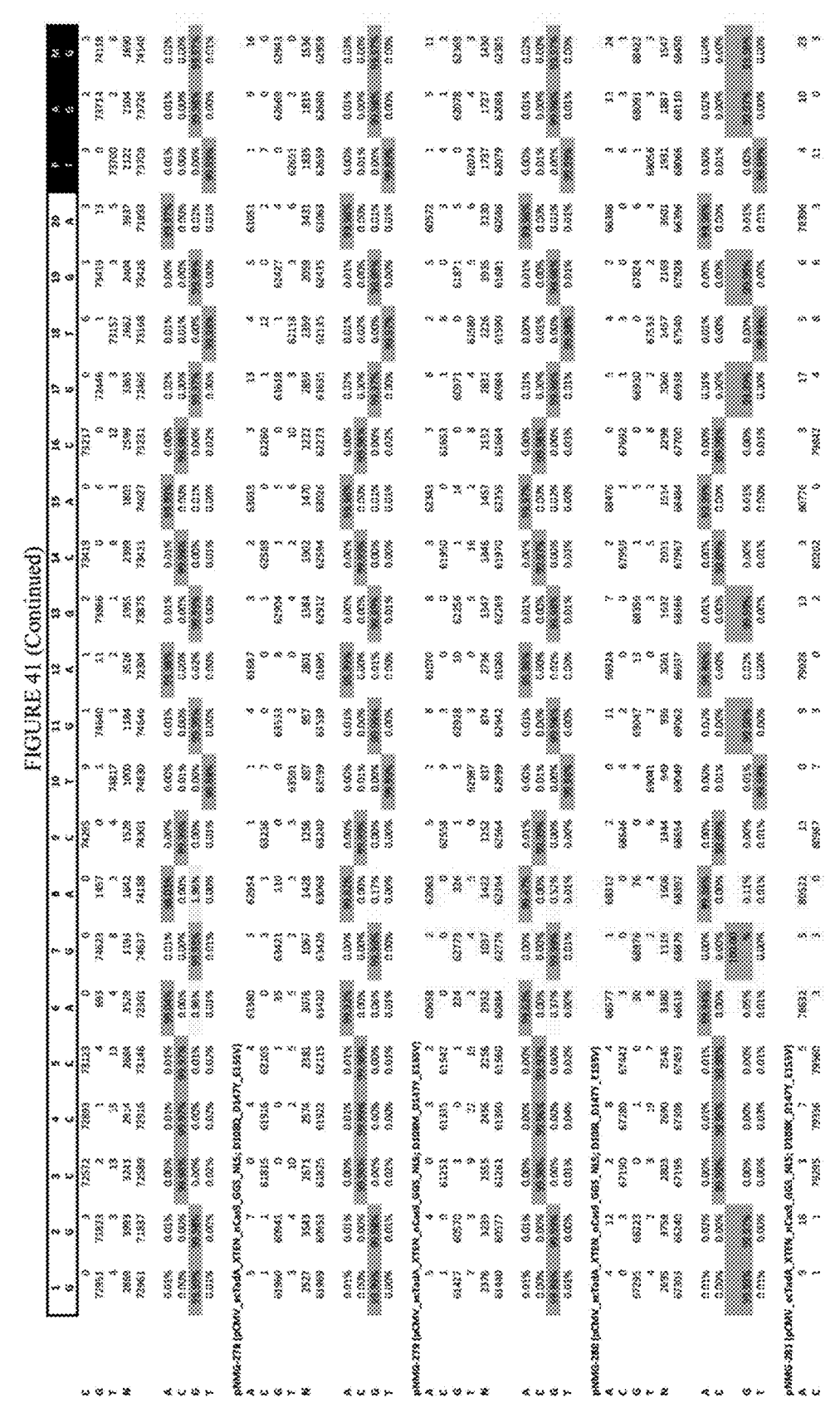
Figure 41:
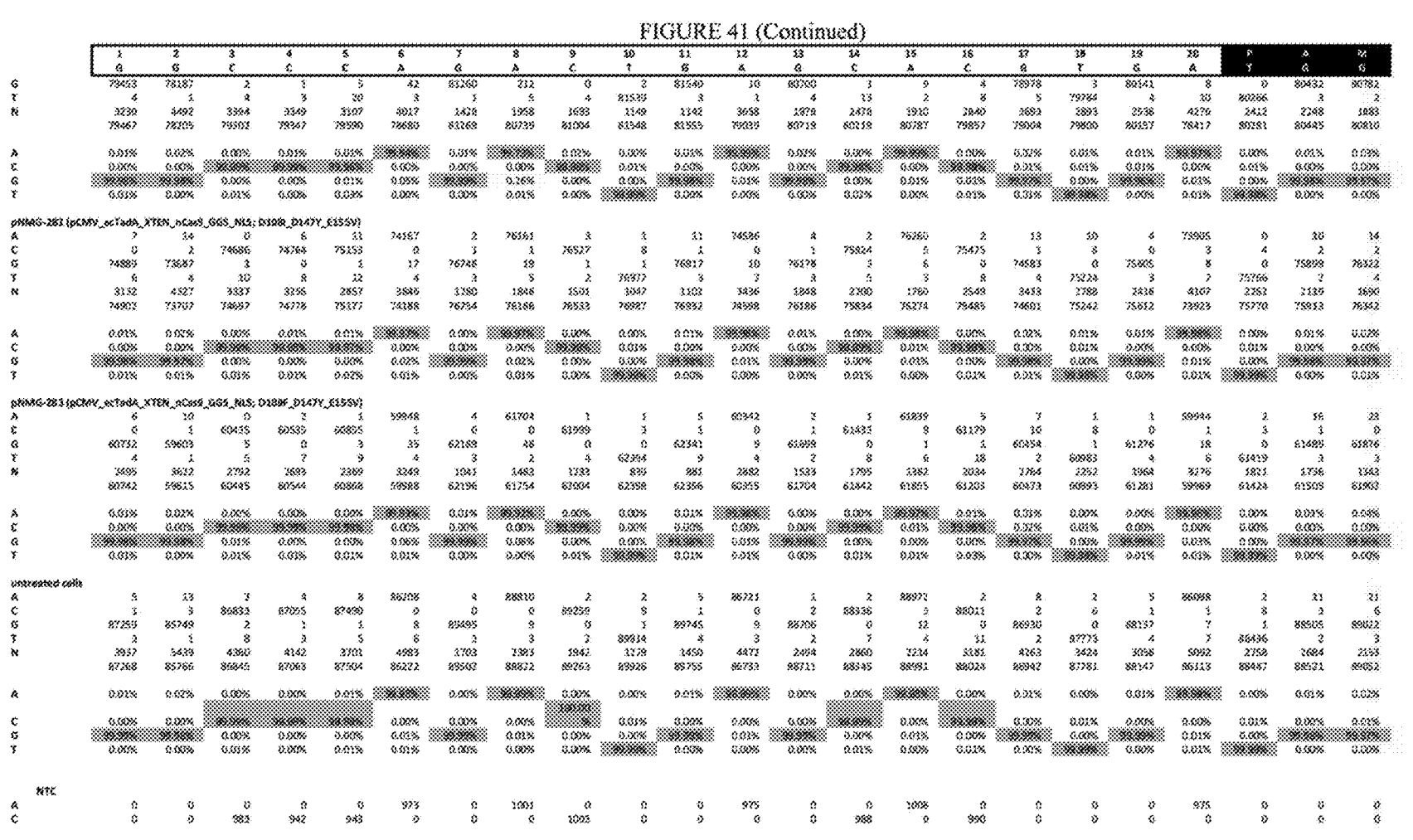
Figure 41:
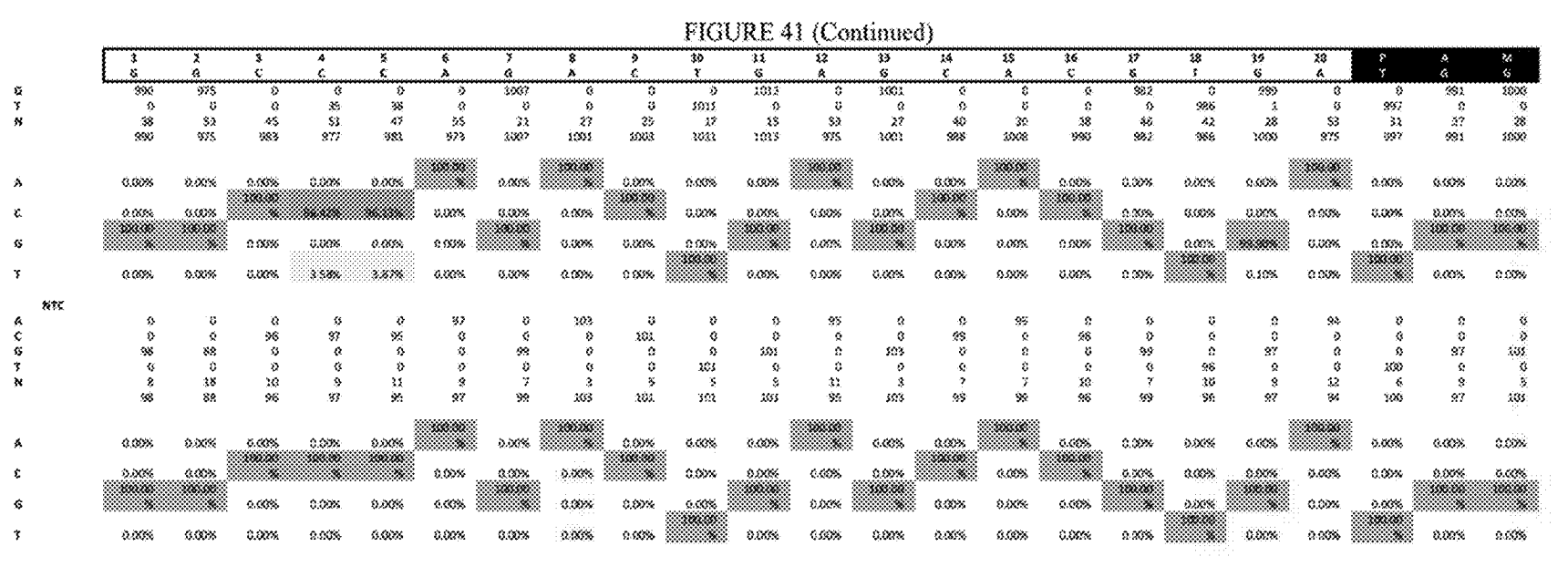

FIG. 41 shows the results of transfection at the Hek-3 site. The sequence corresponds to SEQ ID NO: 42.

Figure 42:
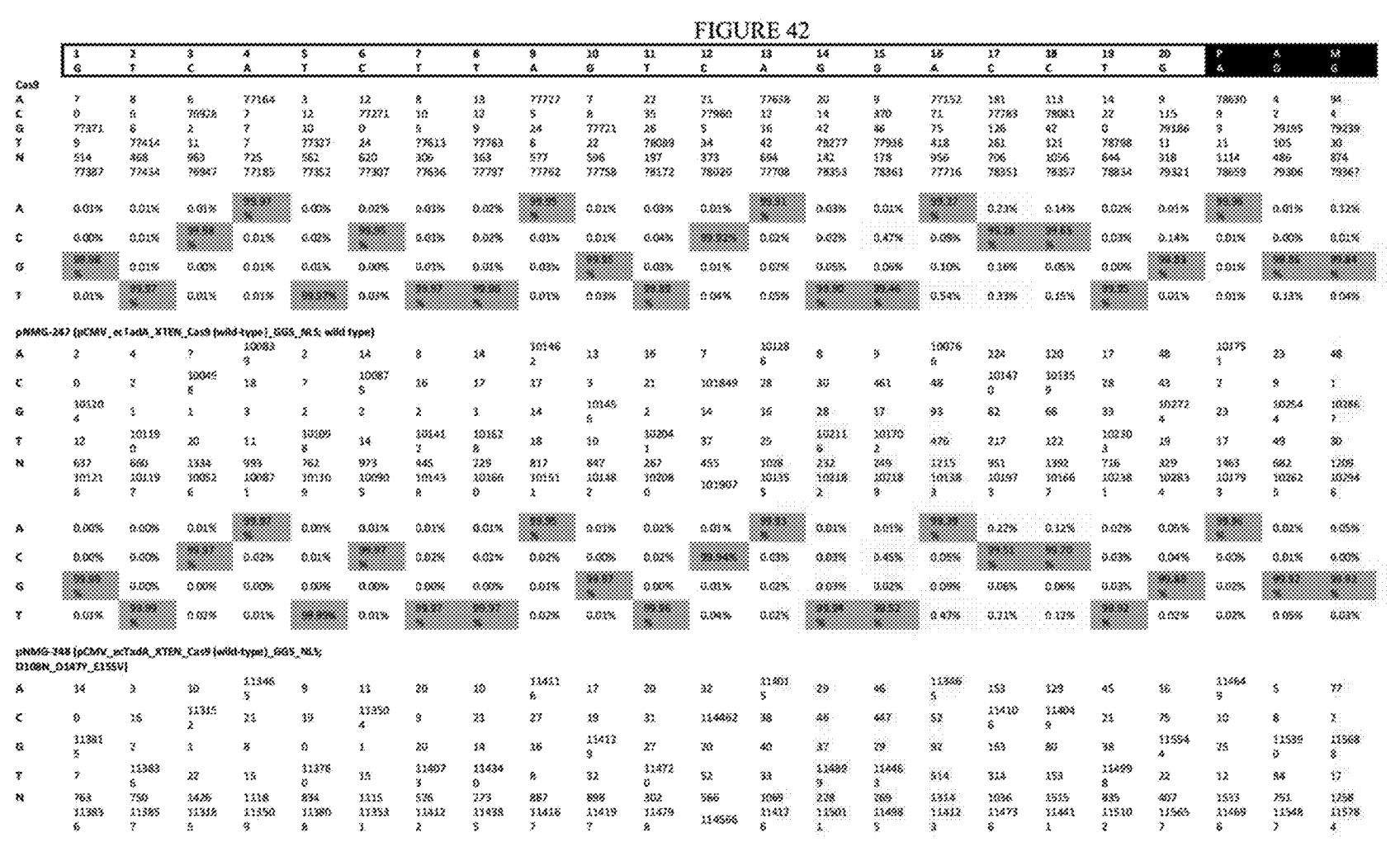
Figure 42:
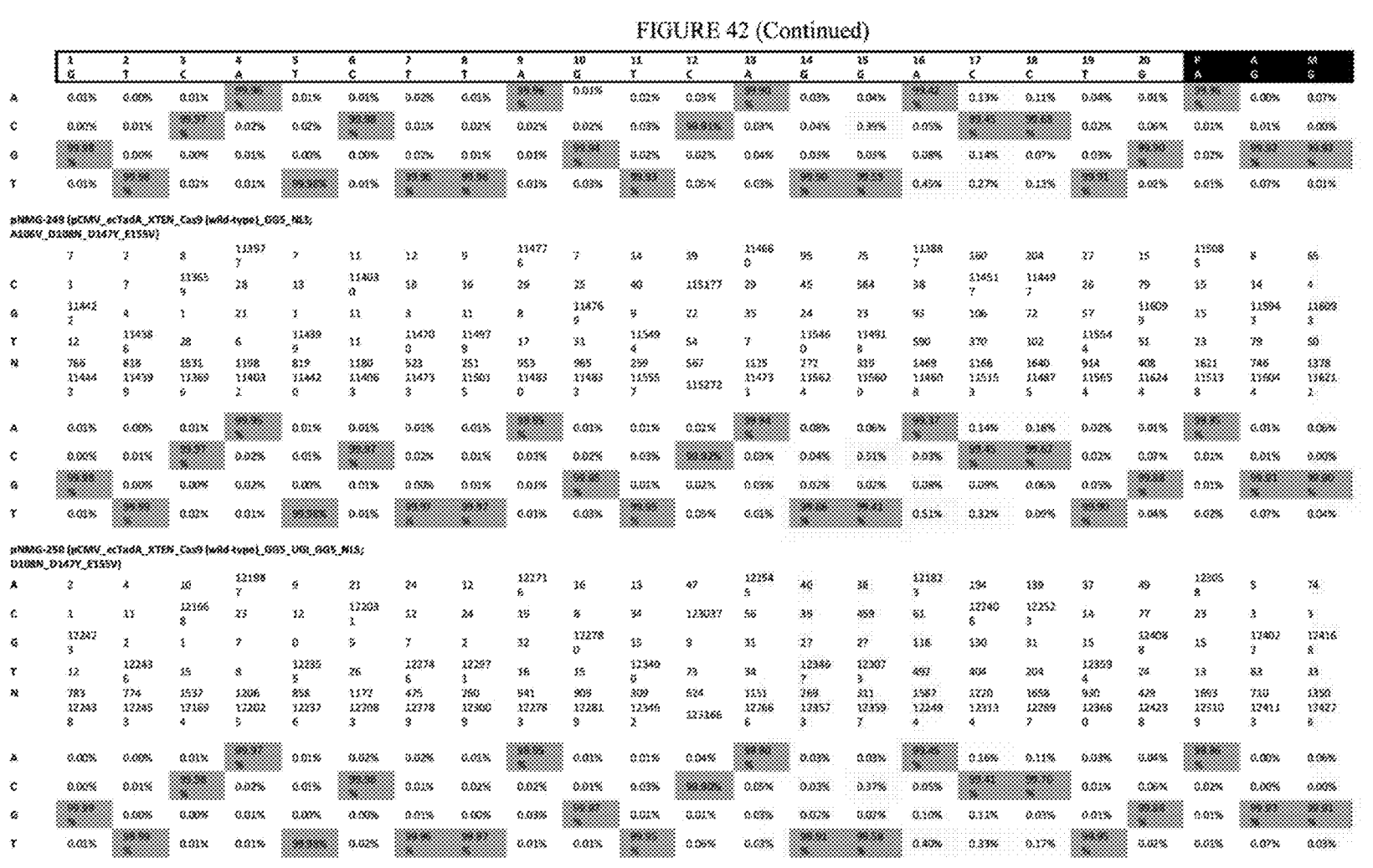
Figure 42:
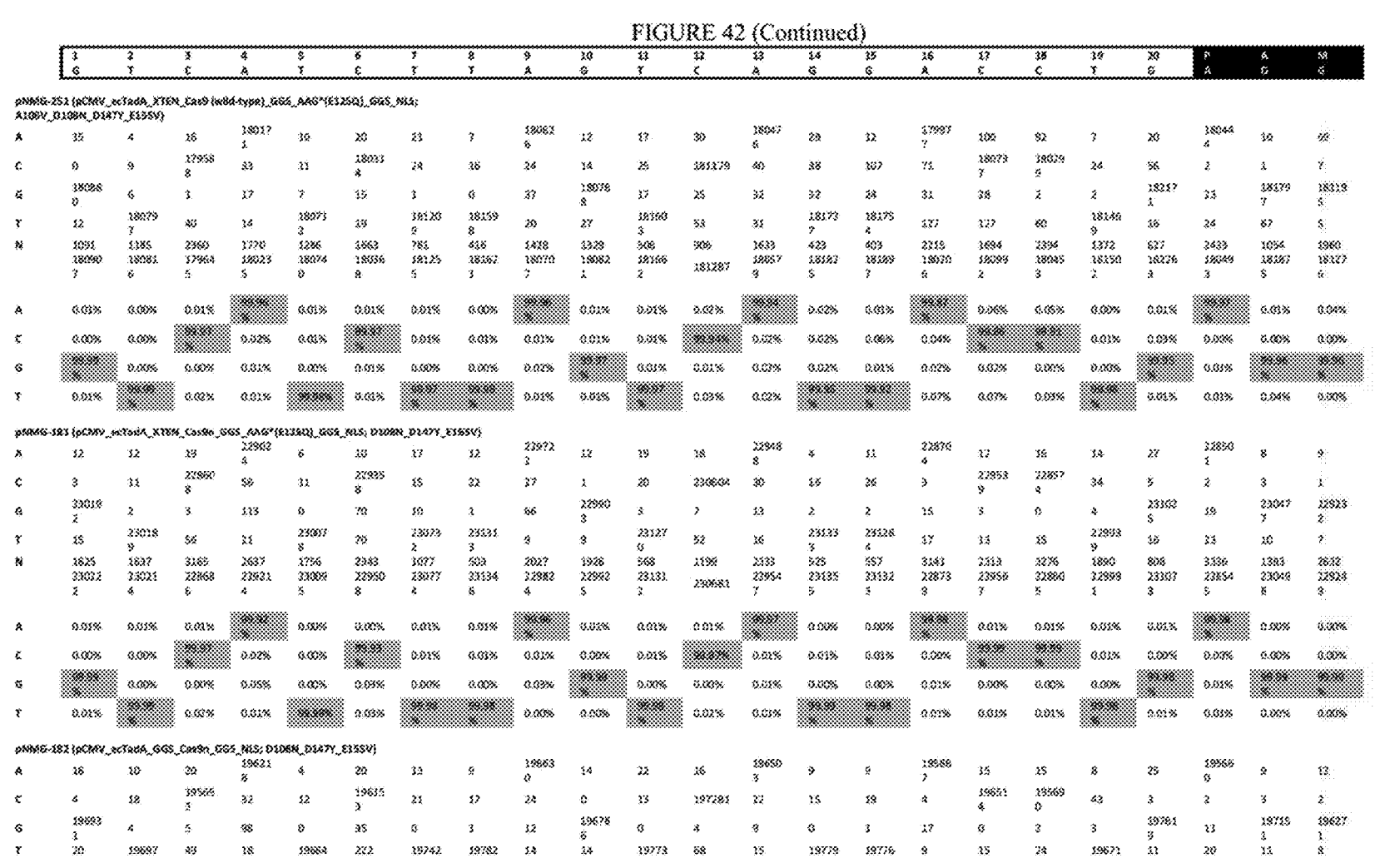
Figure 42:
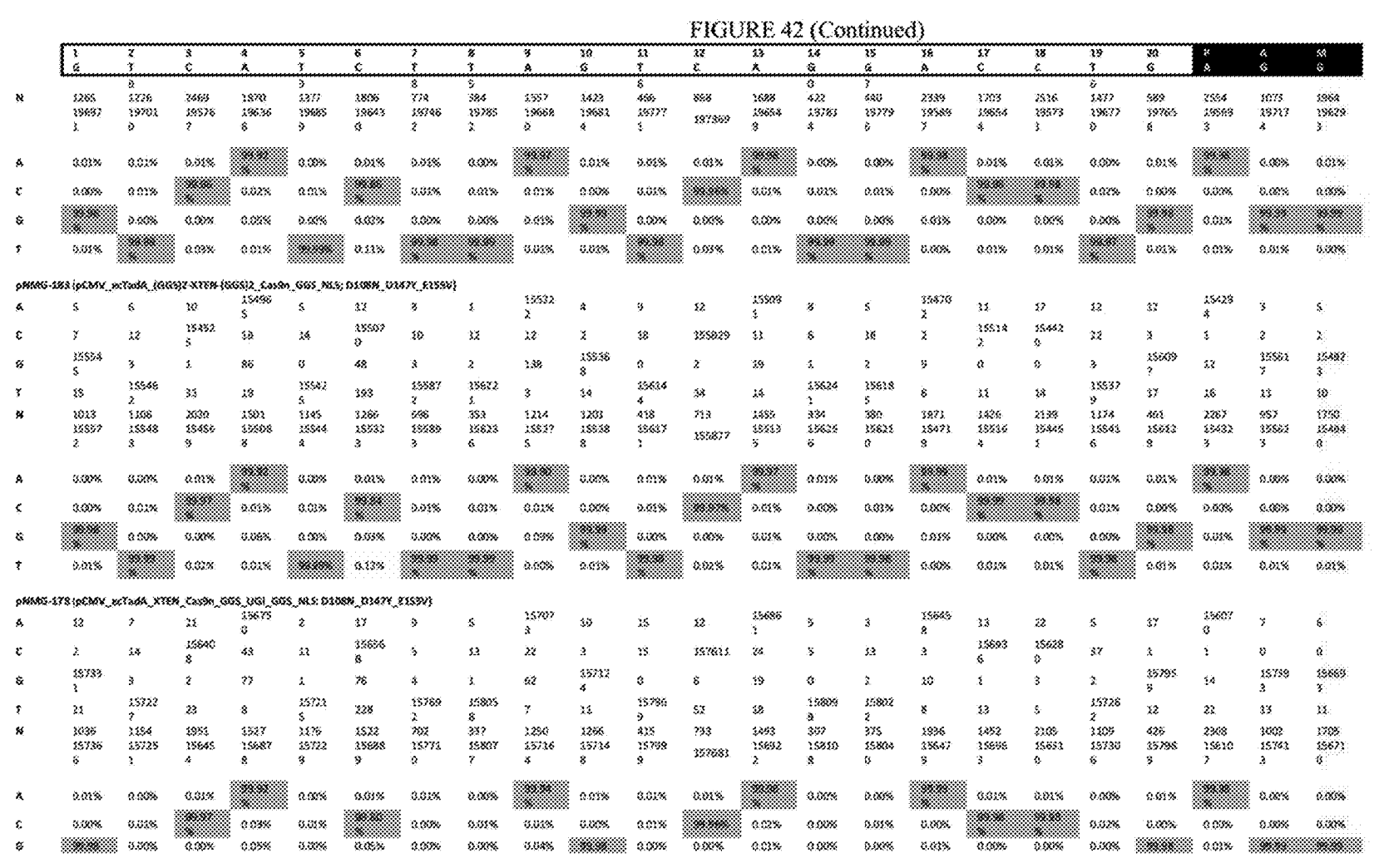
Figure 42:
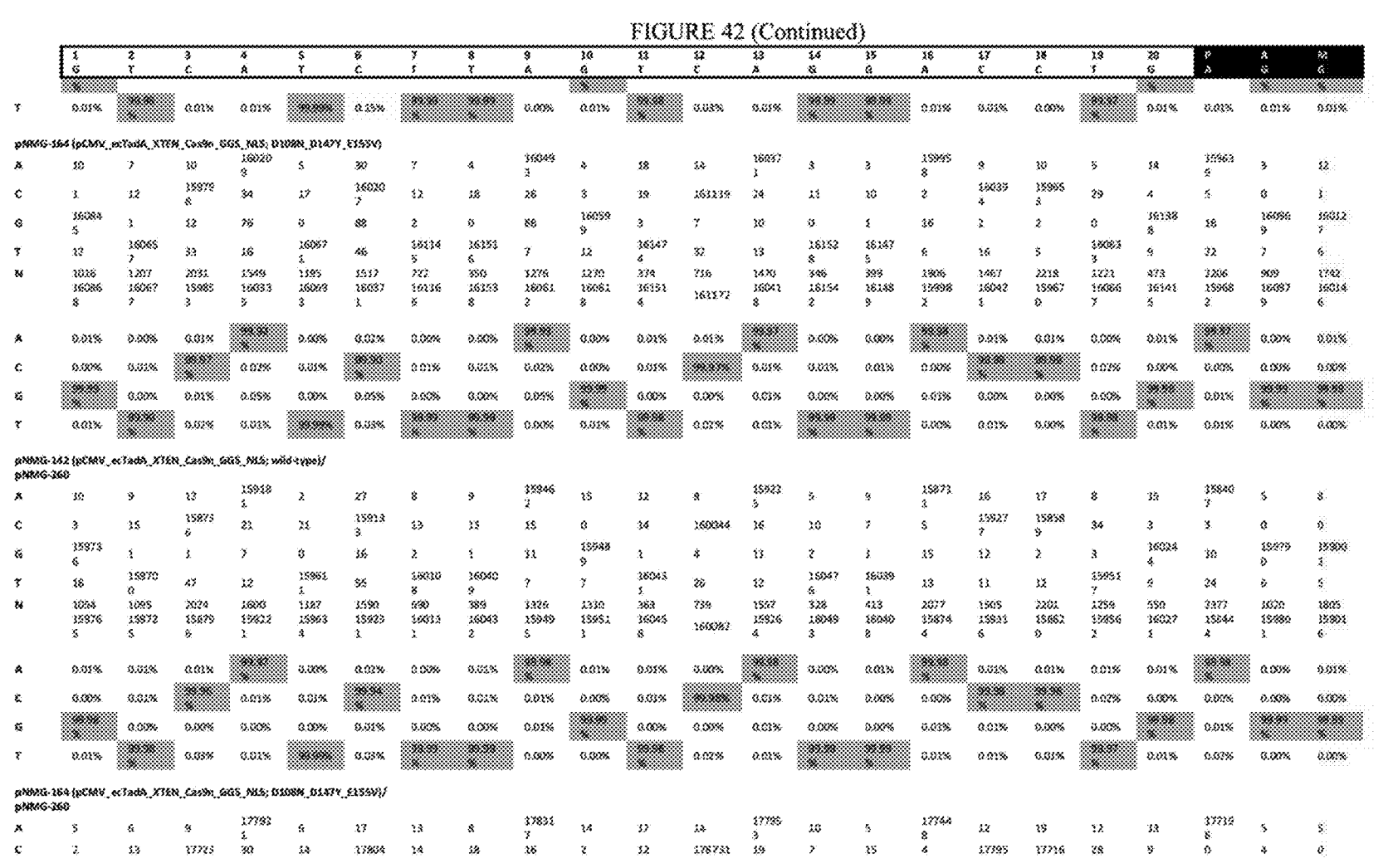
Figure 42:
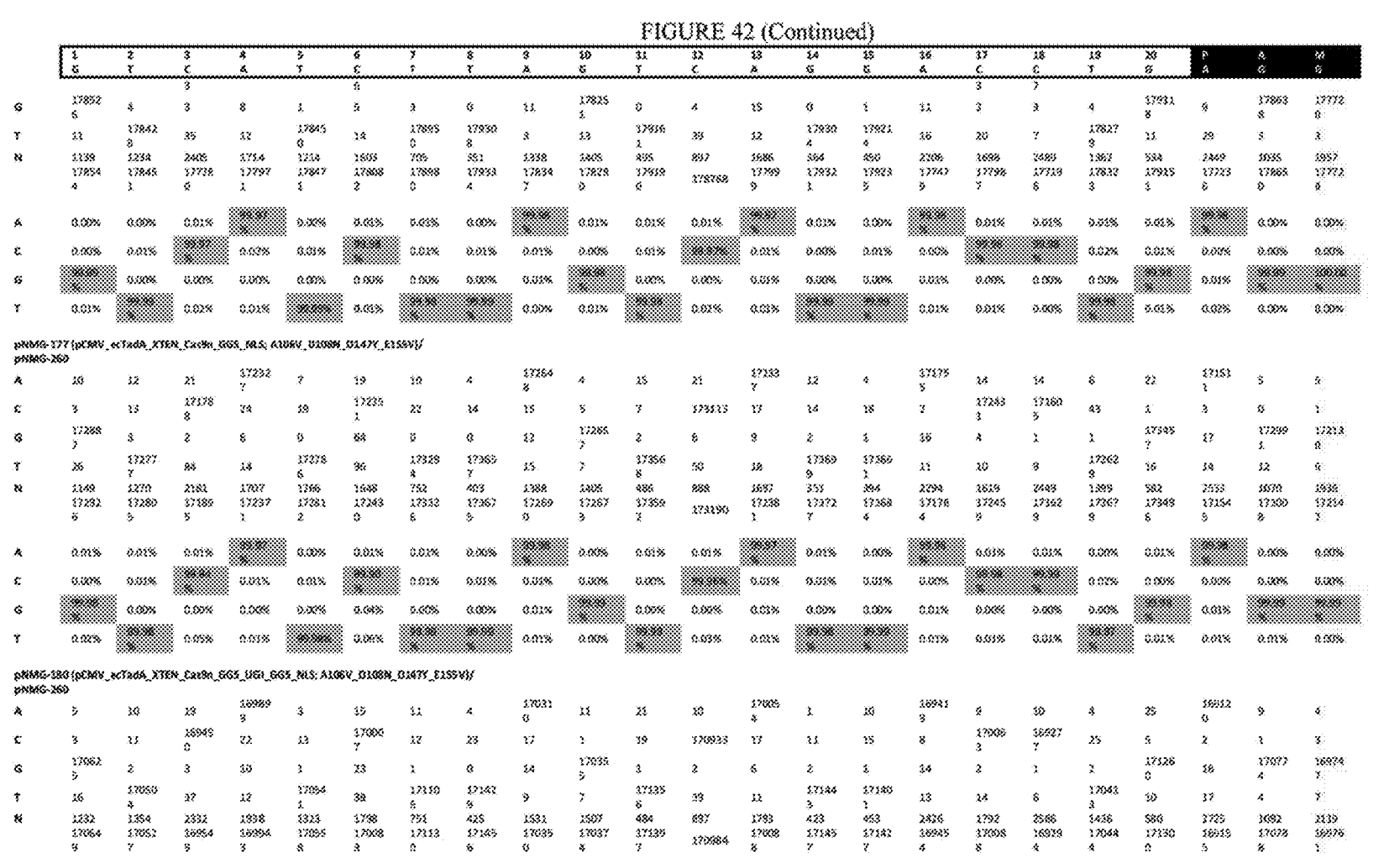
Figure 42:
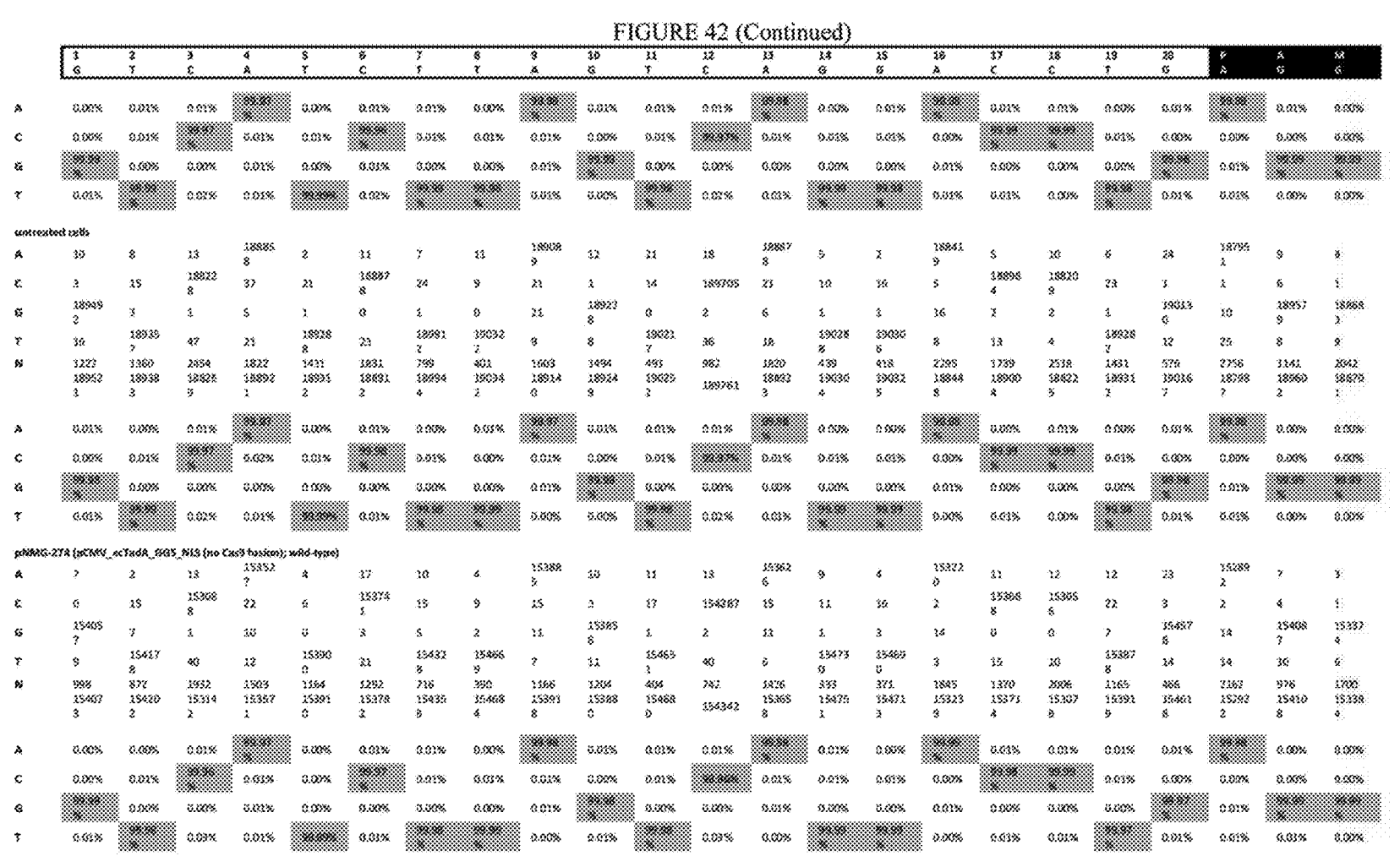
Figure 42:
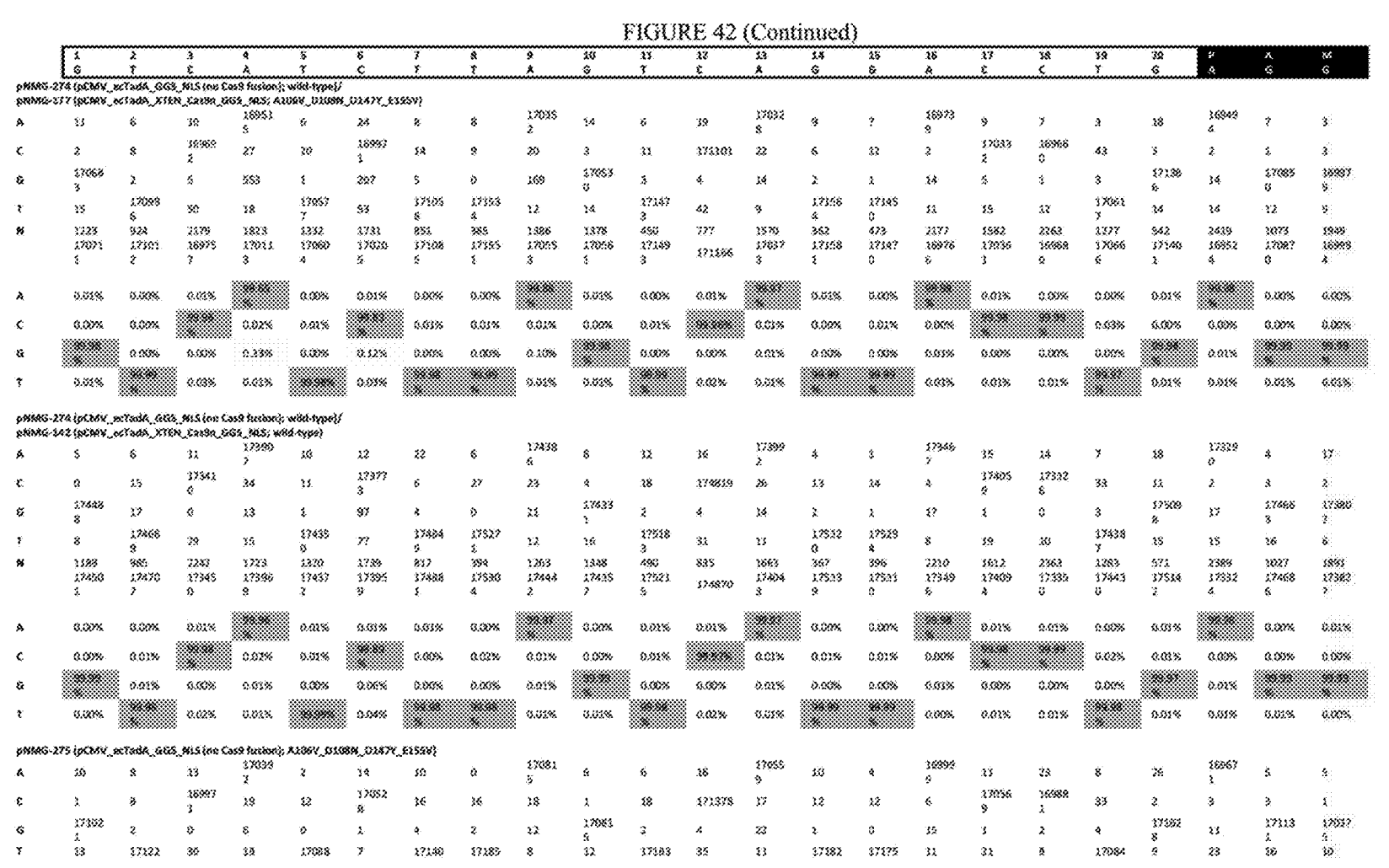
Figure 42:
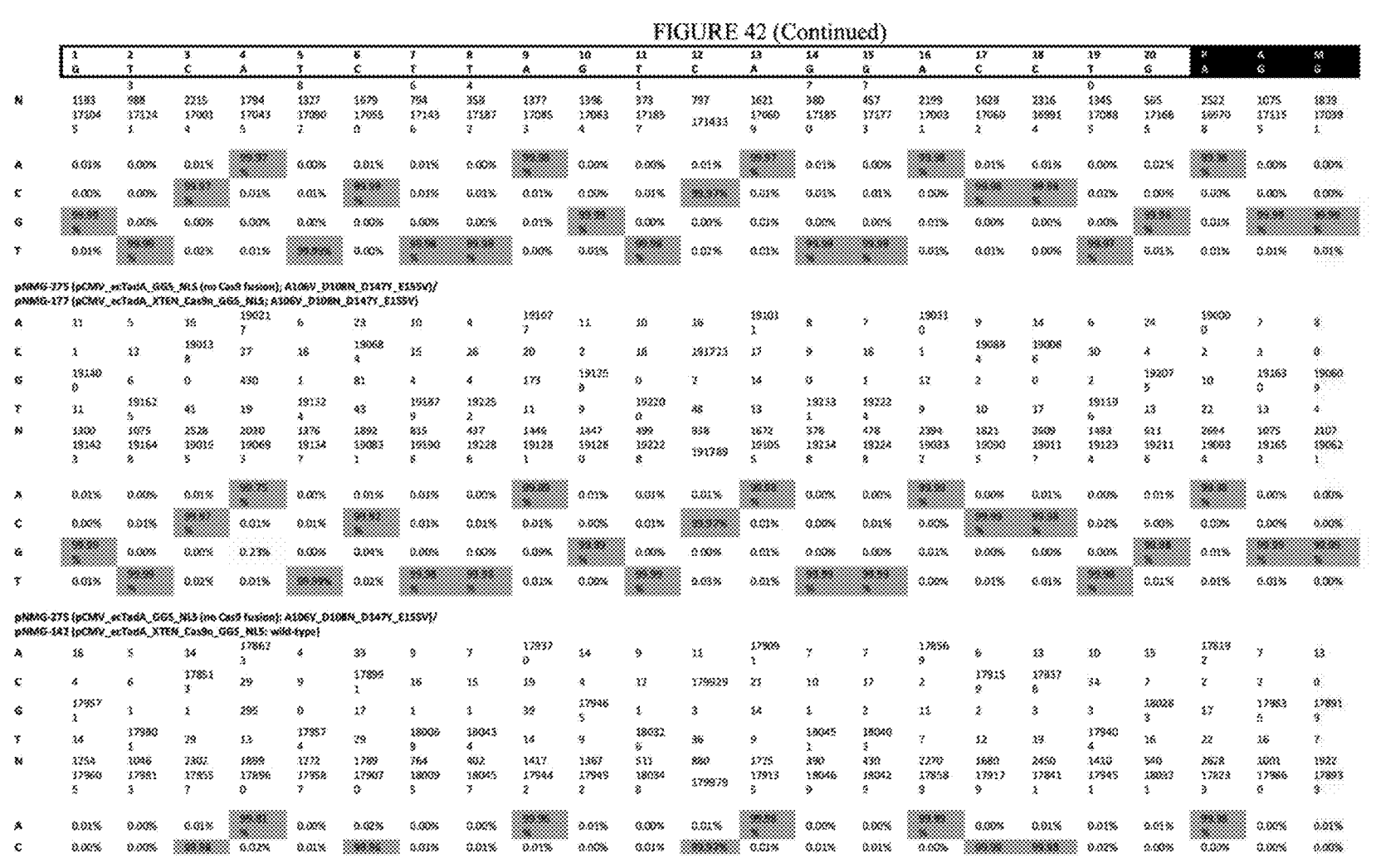
Figure 42:
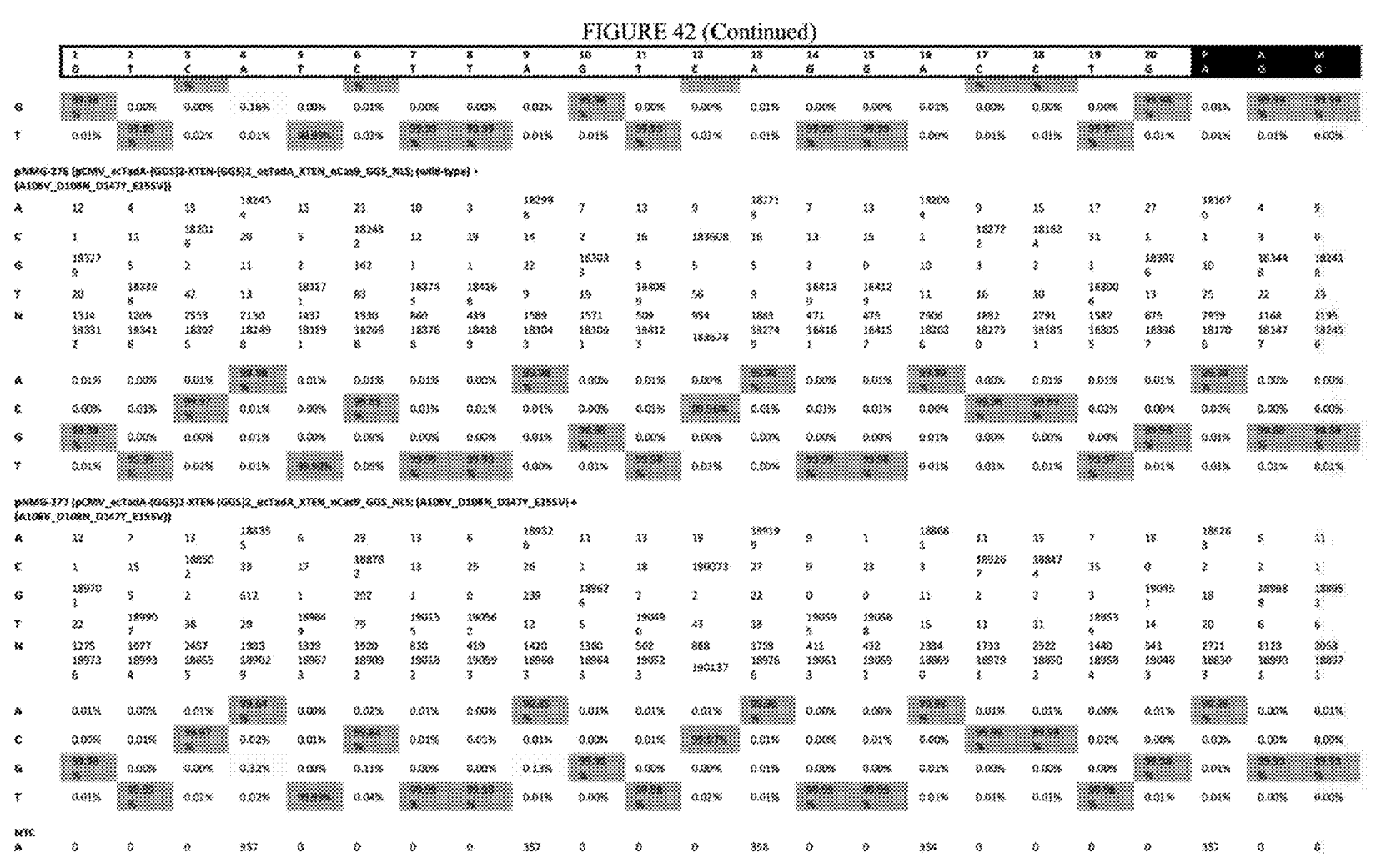
Figure 42:
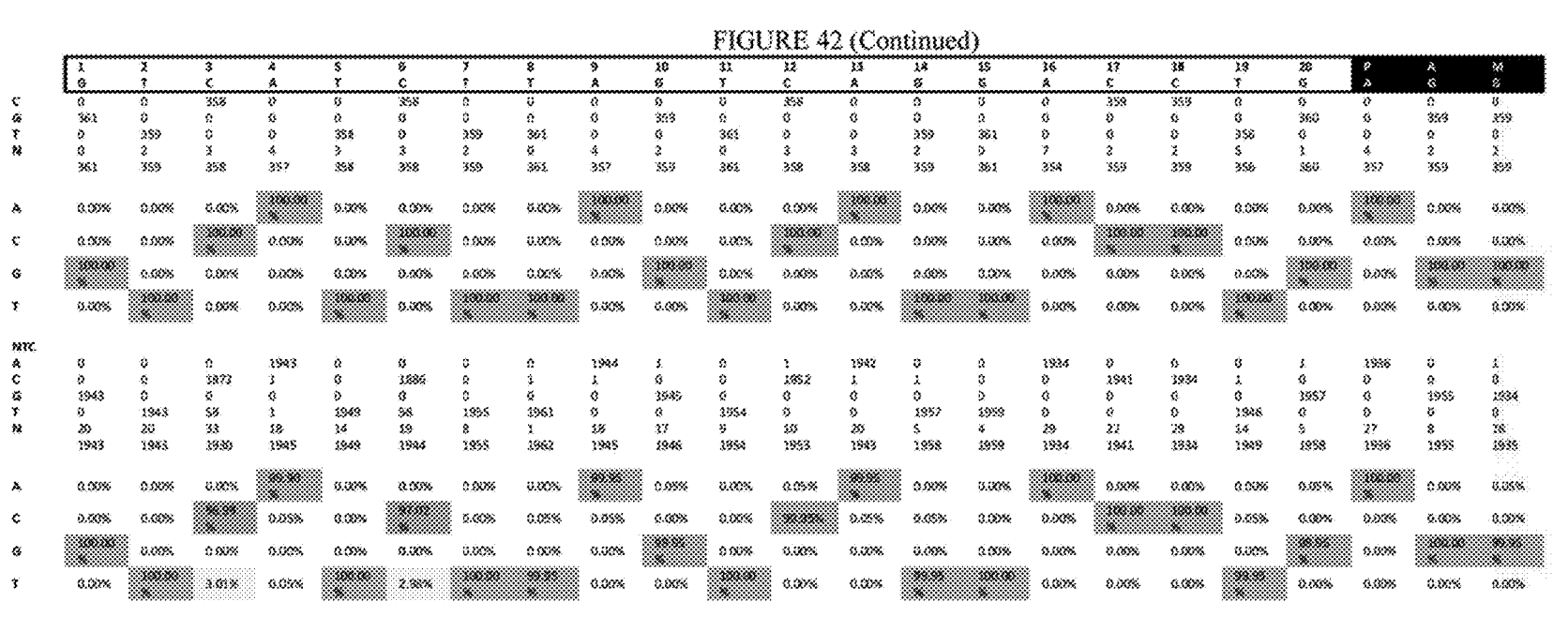

FIG. 42 shows the results of transfection at the RNF-2 site. The sequence corresponds to SEQ ID NO: 44.

Figure 43:
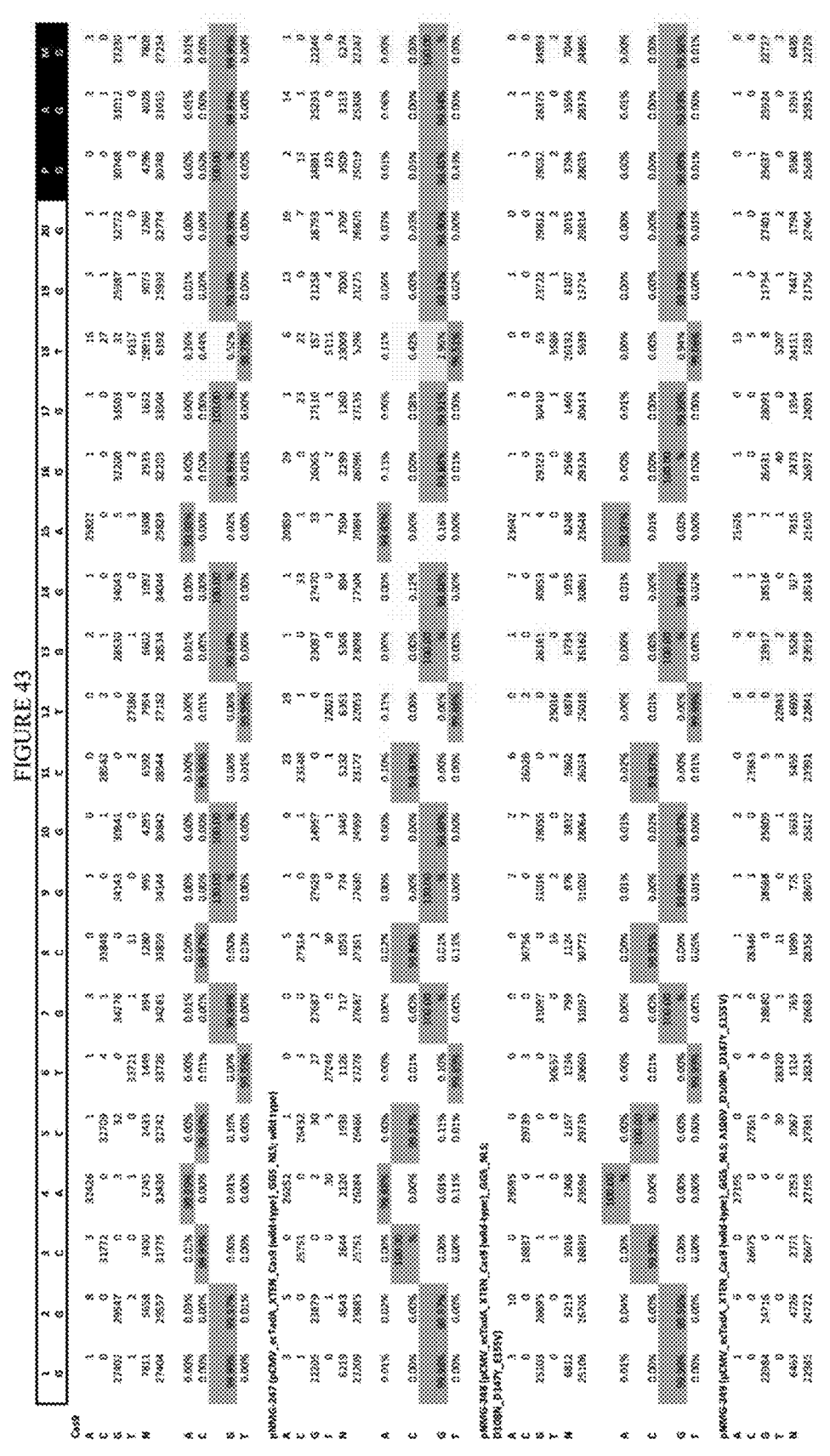
Figure 43:
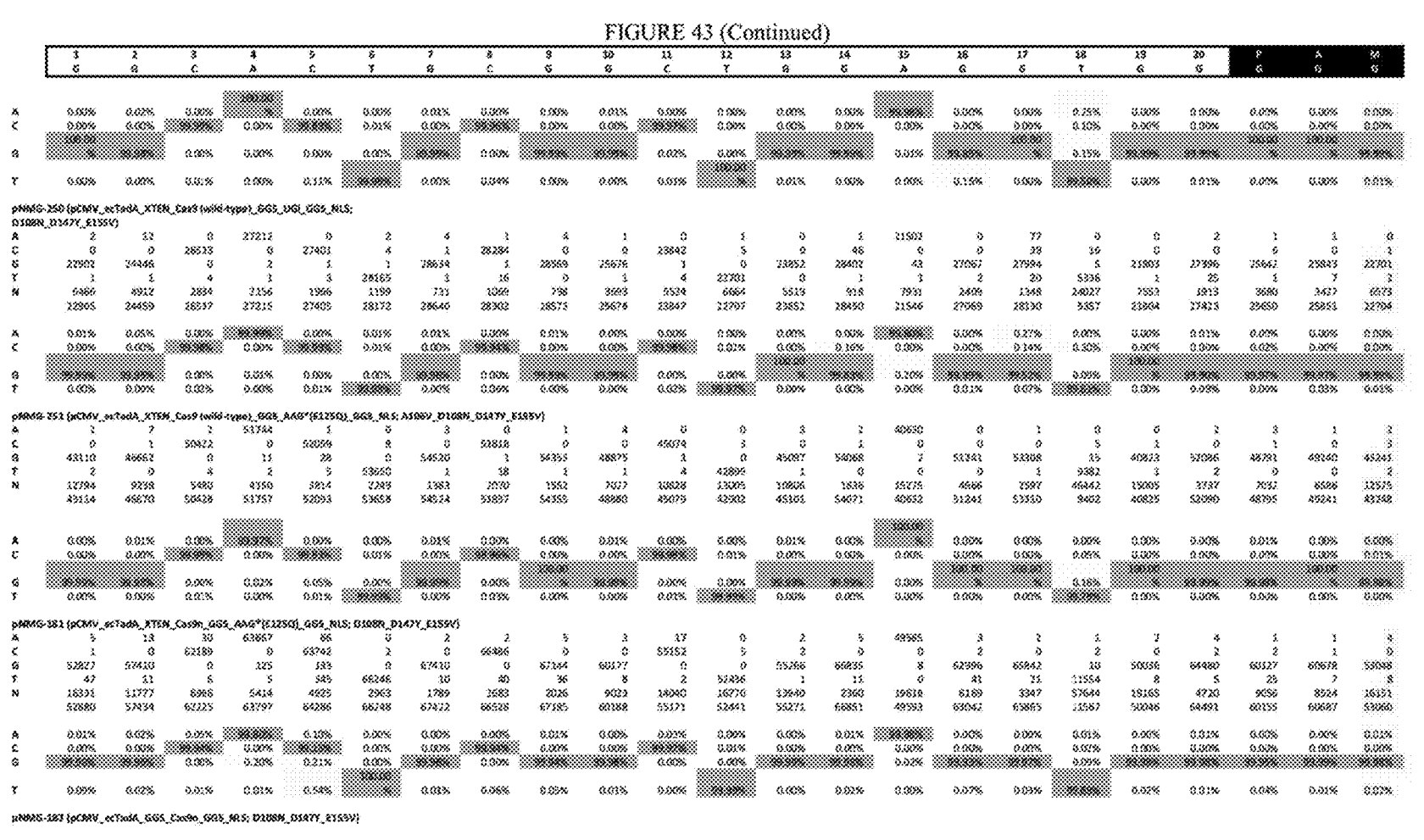
Figure 43:
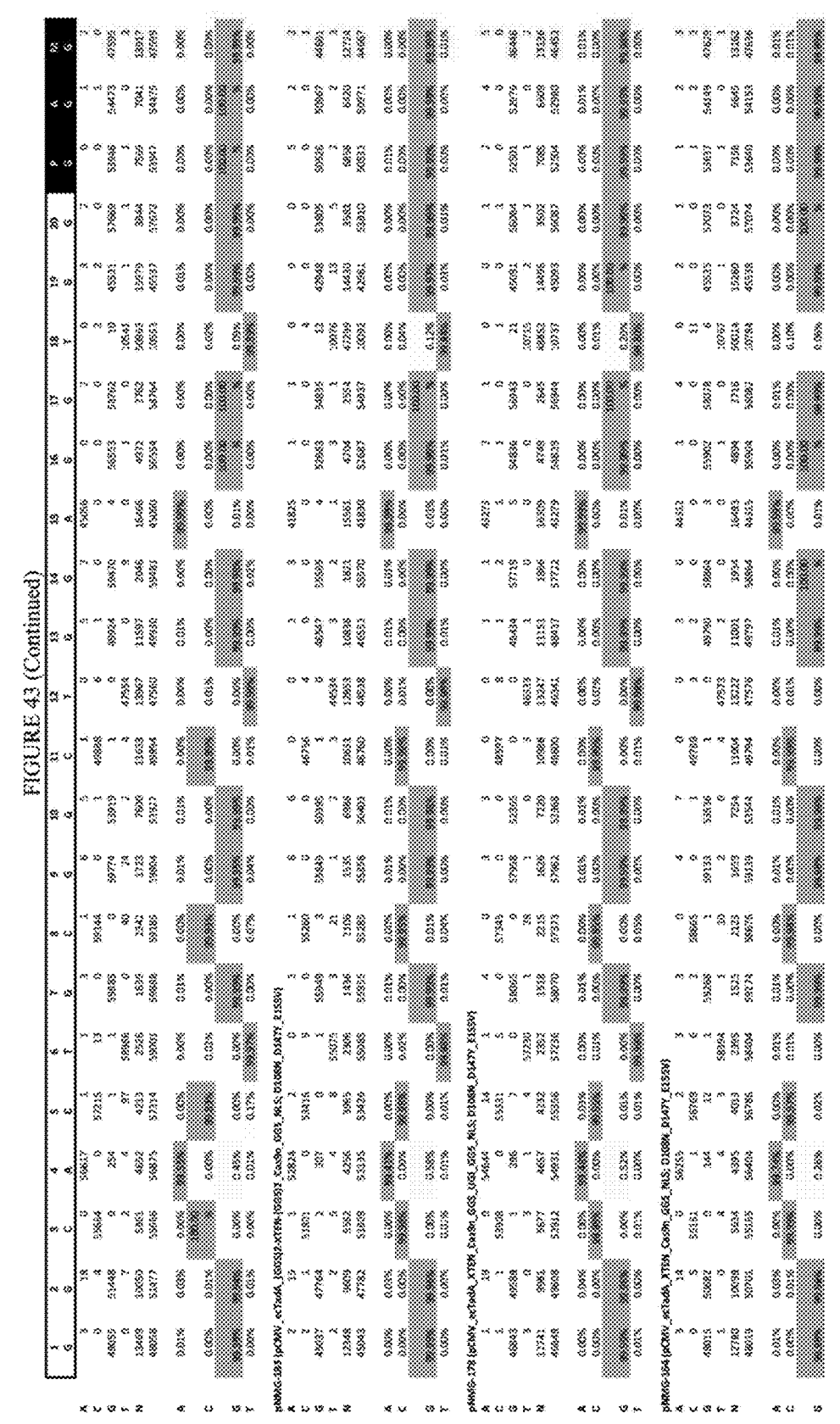
Figure 43:
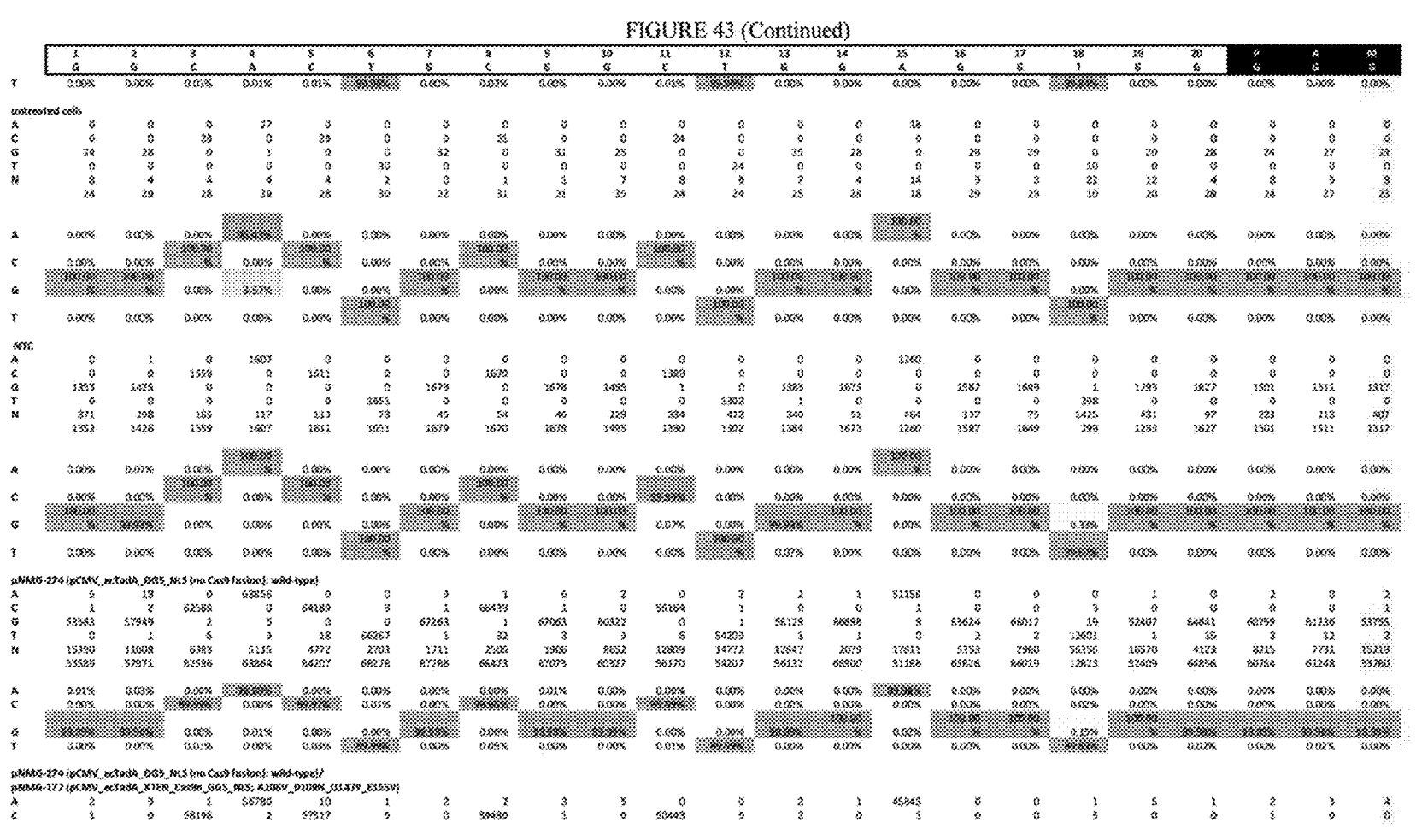
Figure 43:
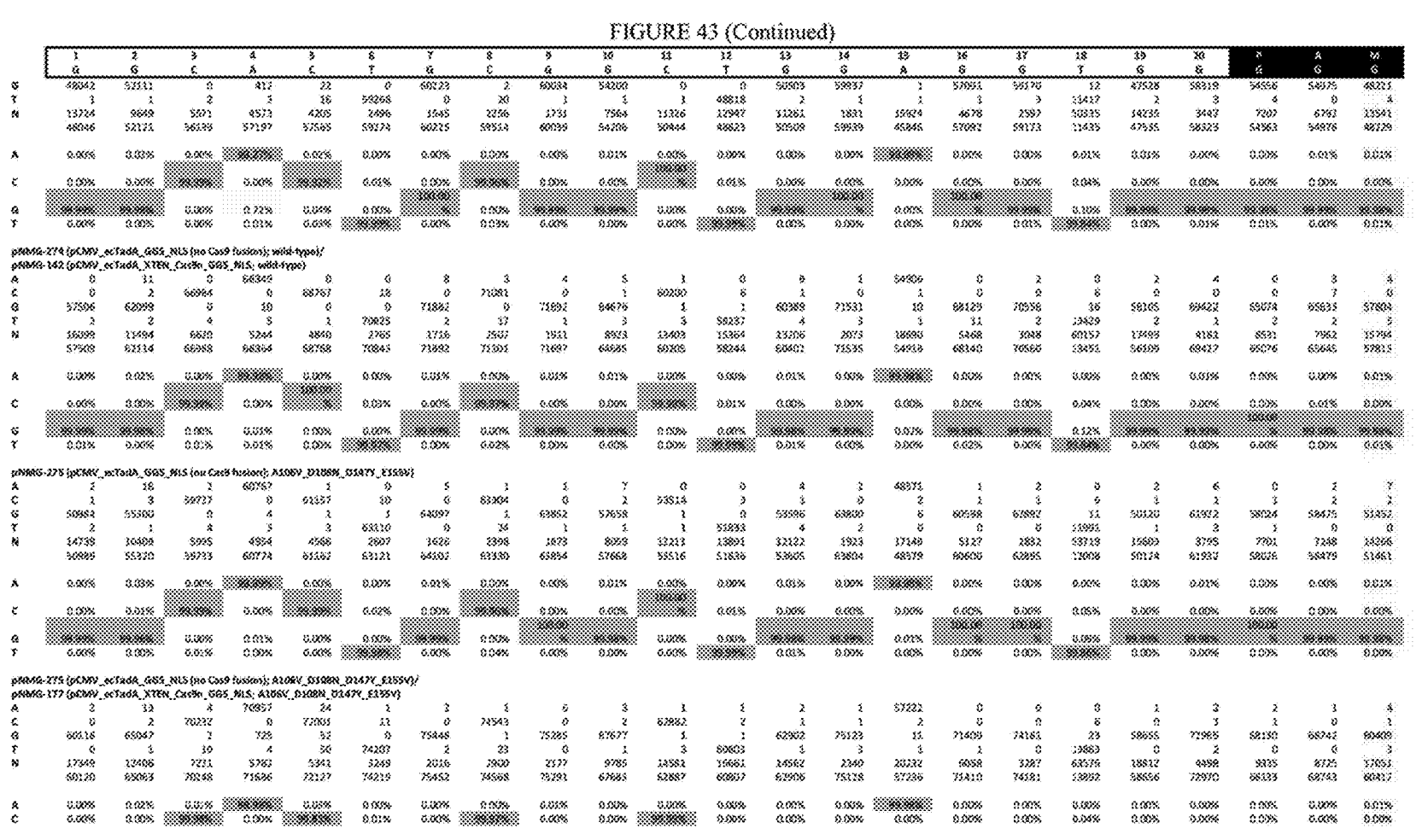
Figure 43:
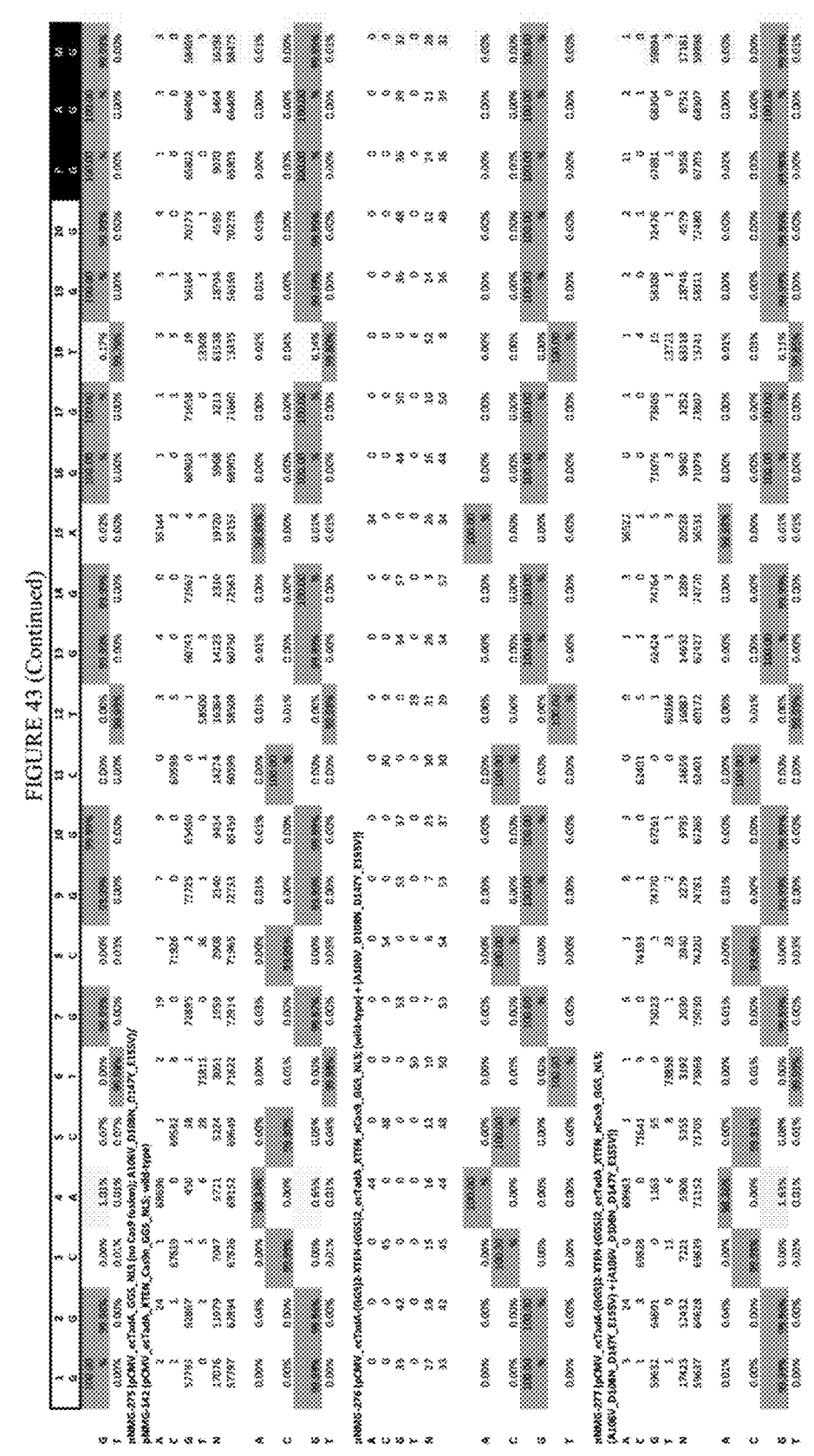

FIG. 43 shows the results of transfection at the Hek-4 site. The sequence corresponds to SEQ ID NO: 43.

Figure 44:
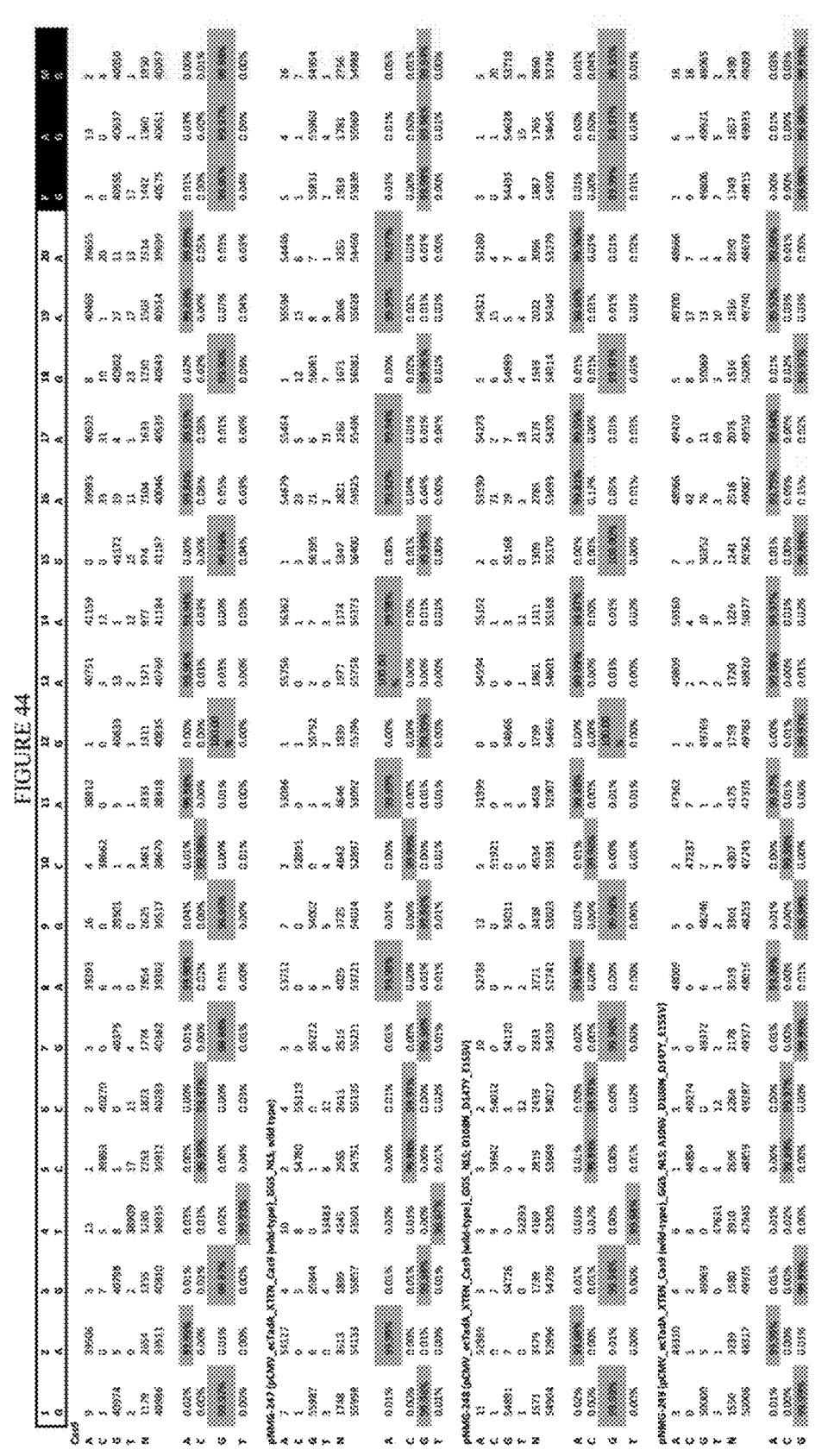
Figure 44:
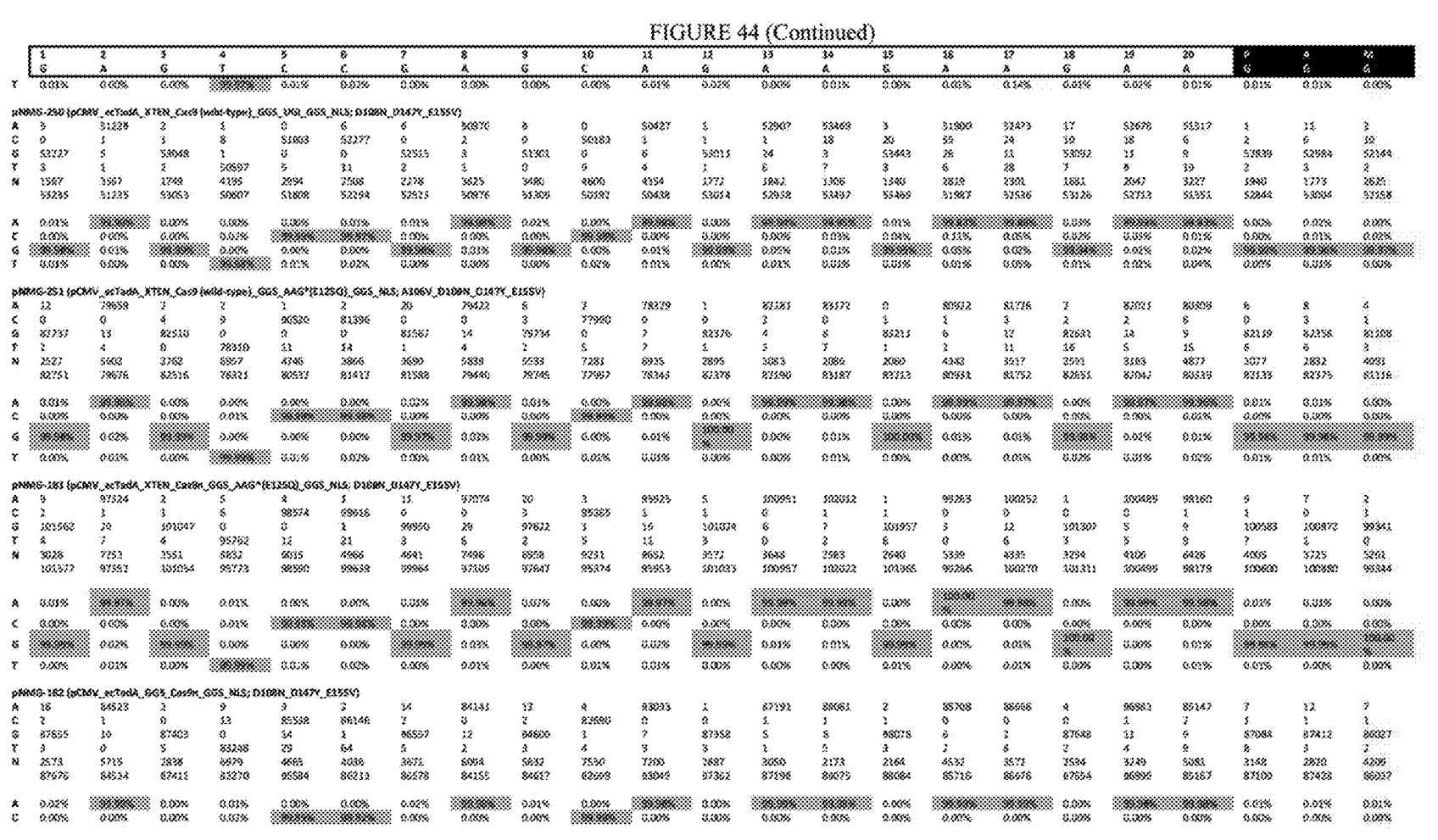
Figure 44:
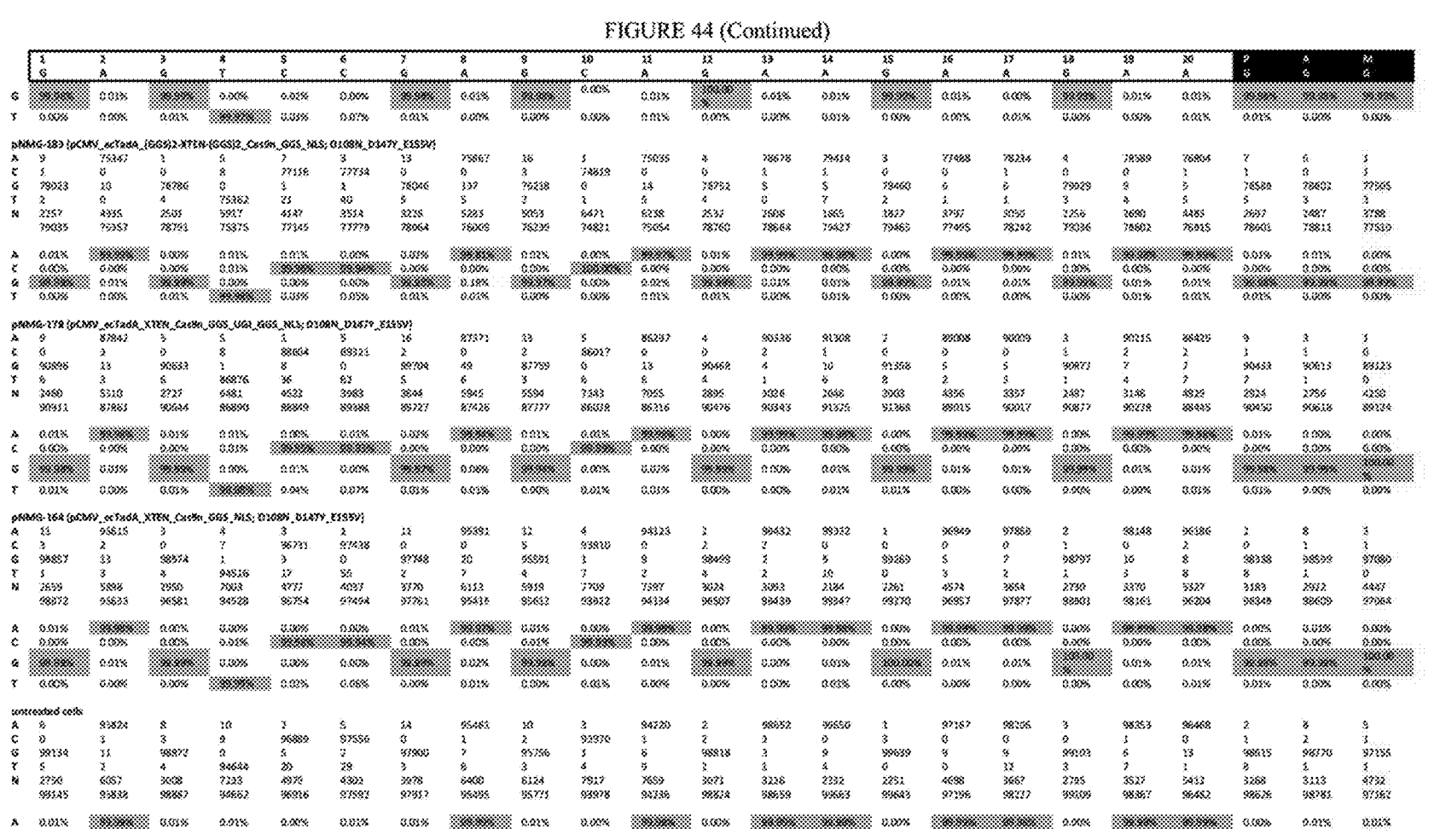
Figure 44:
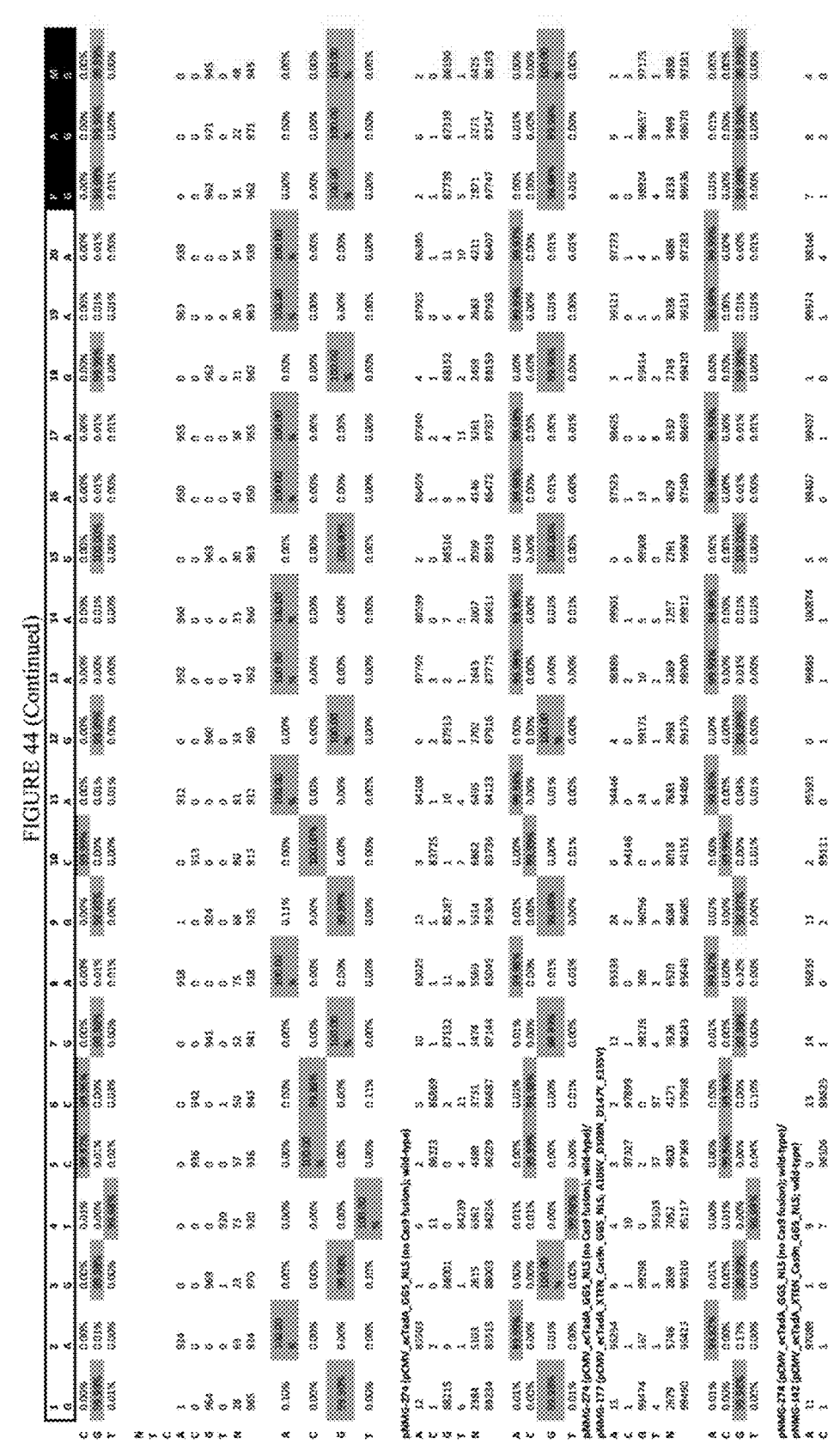
Figure 44:
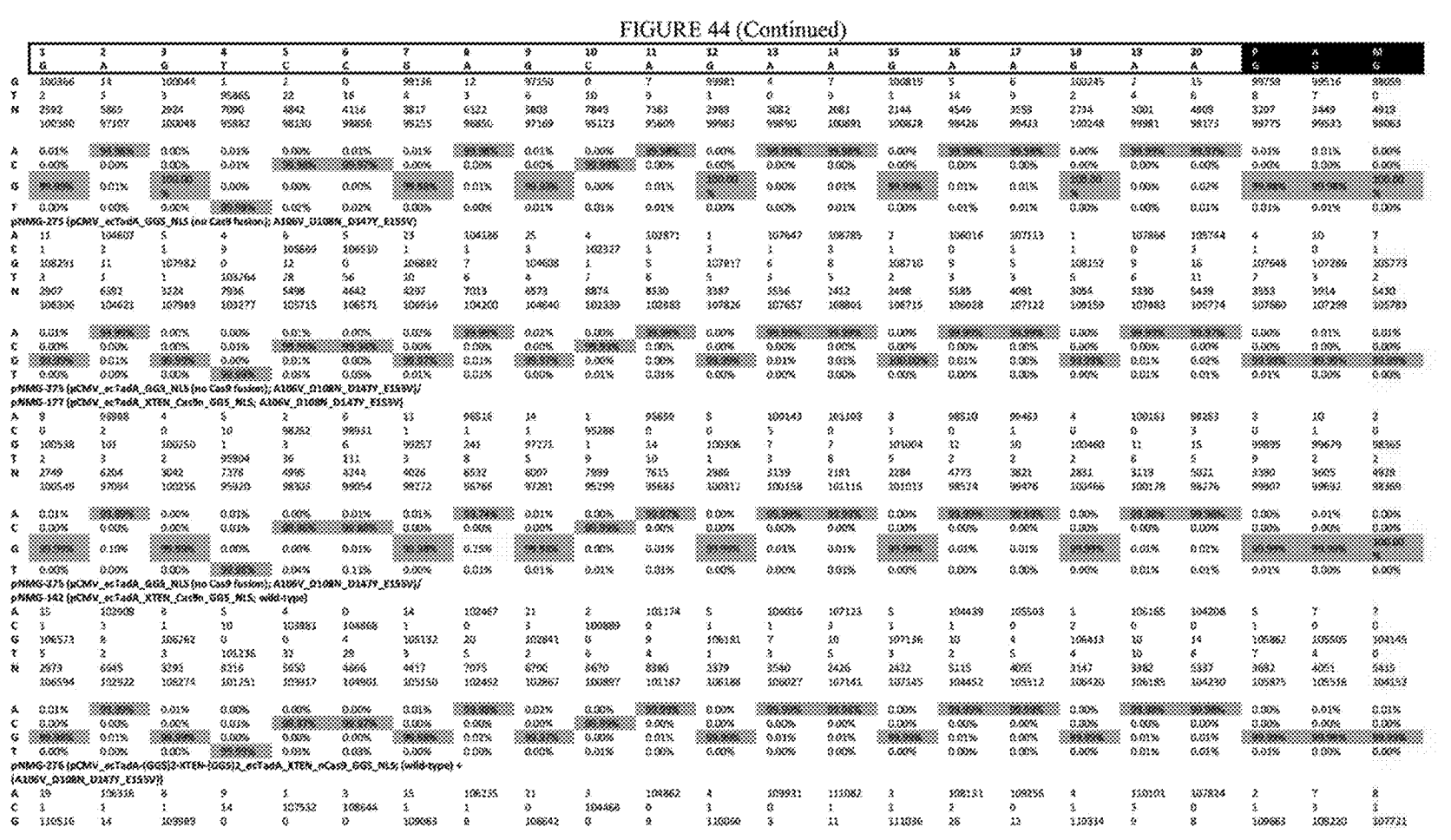
Figure 44:
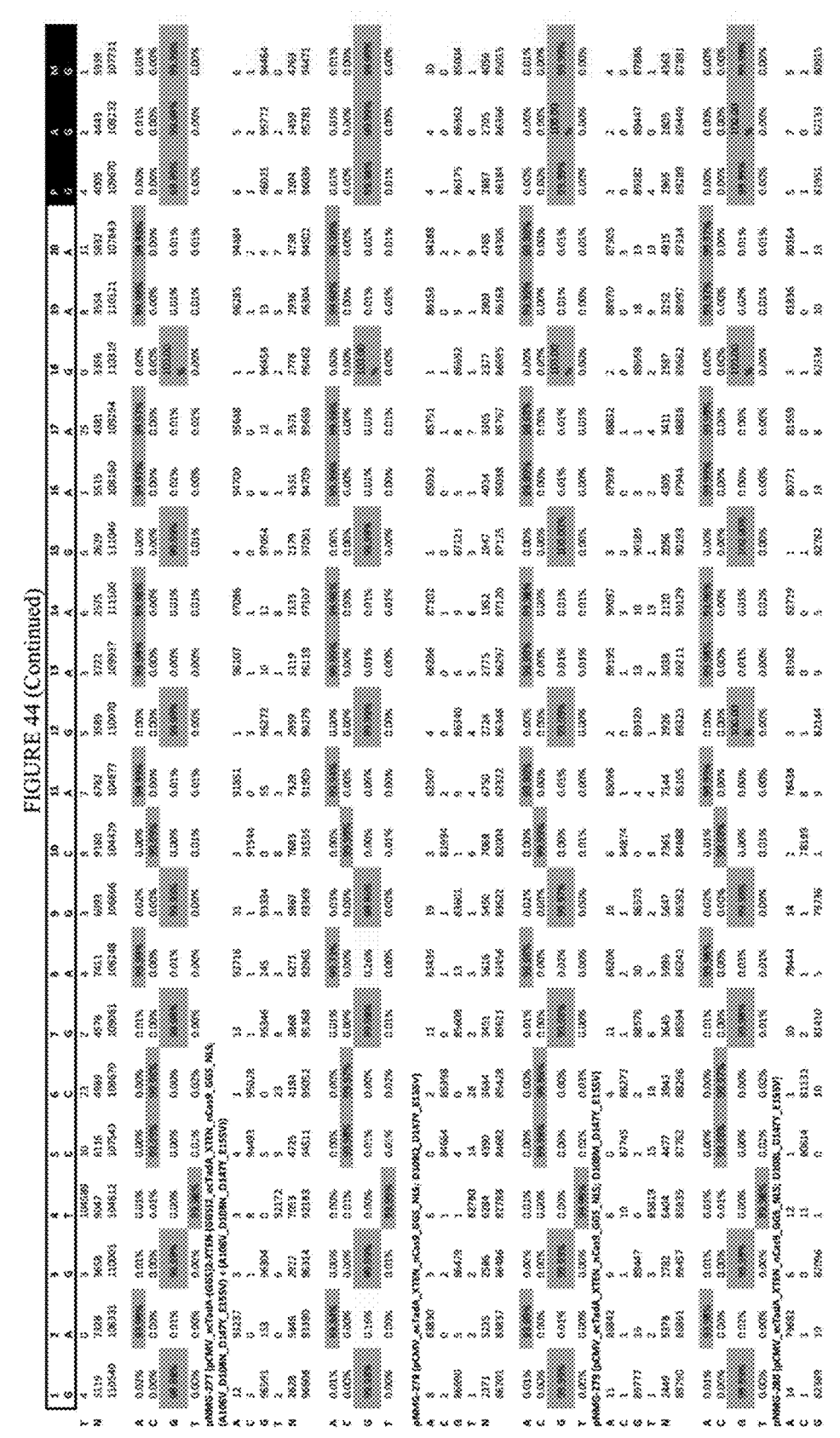
Figure 44:
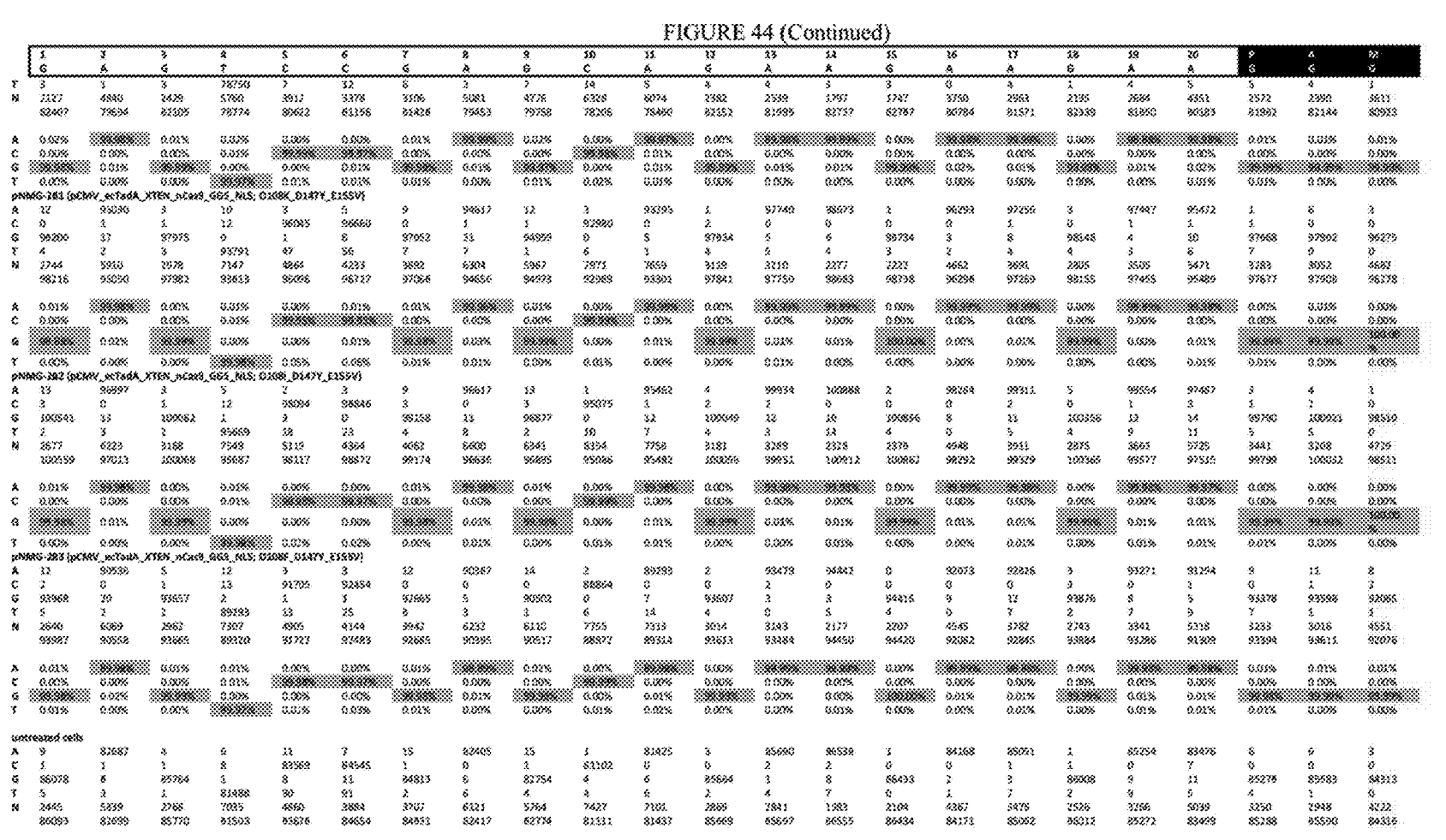
Figure 44:
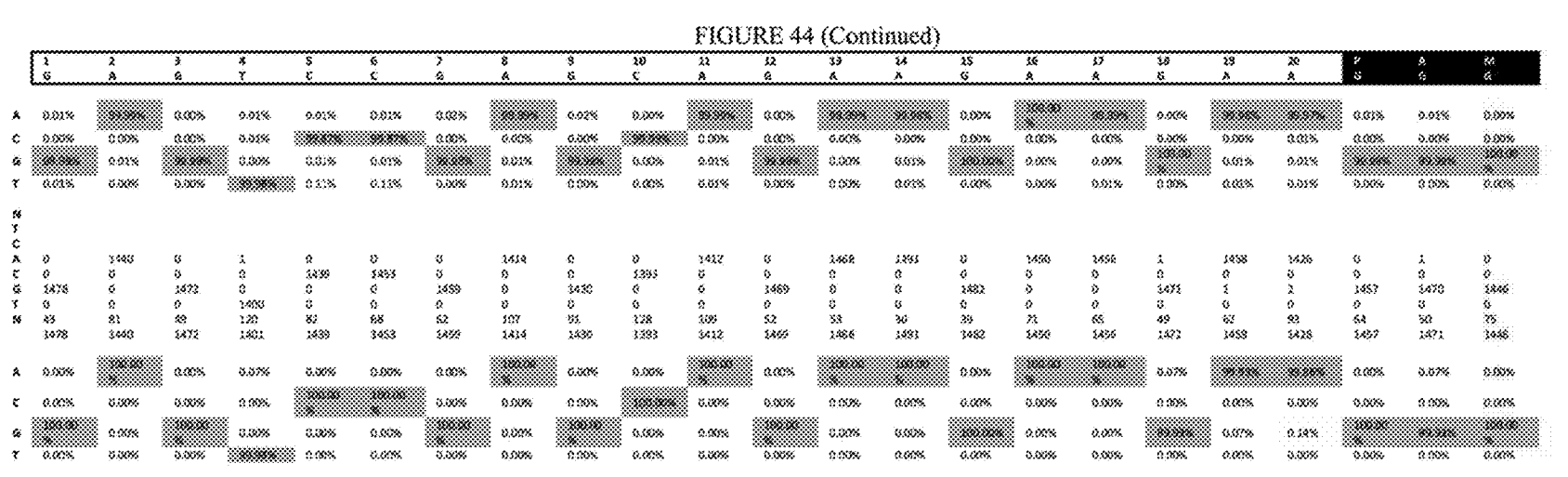

FIG. 44 shows the results of transfection at the EMX-1 site. The sequence corresponds to SEQ ID NO: 46.

Figure 45:
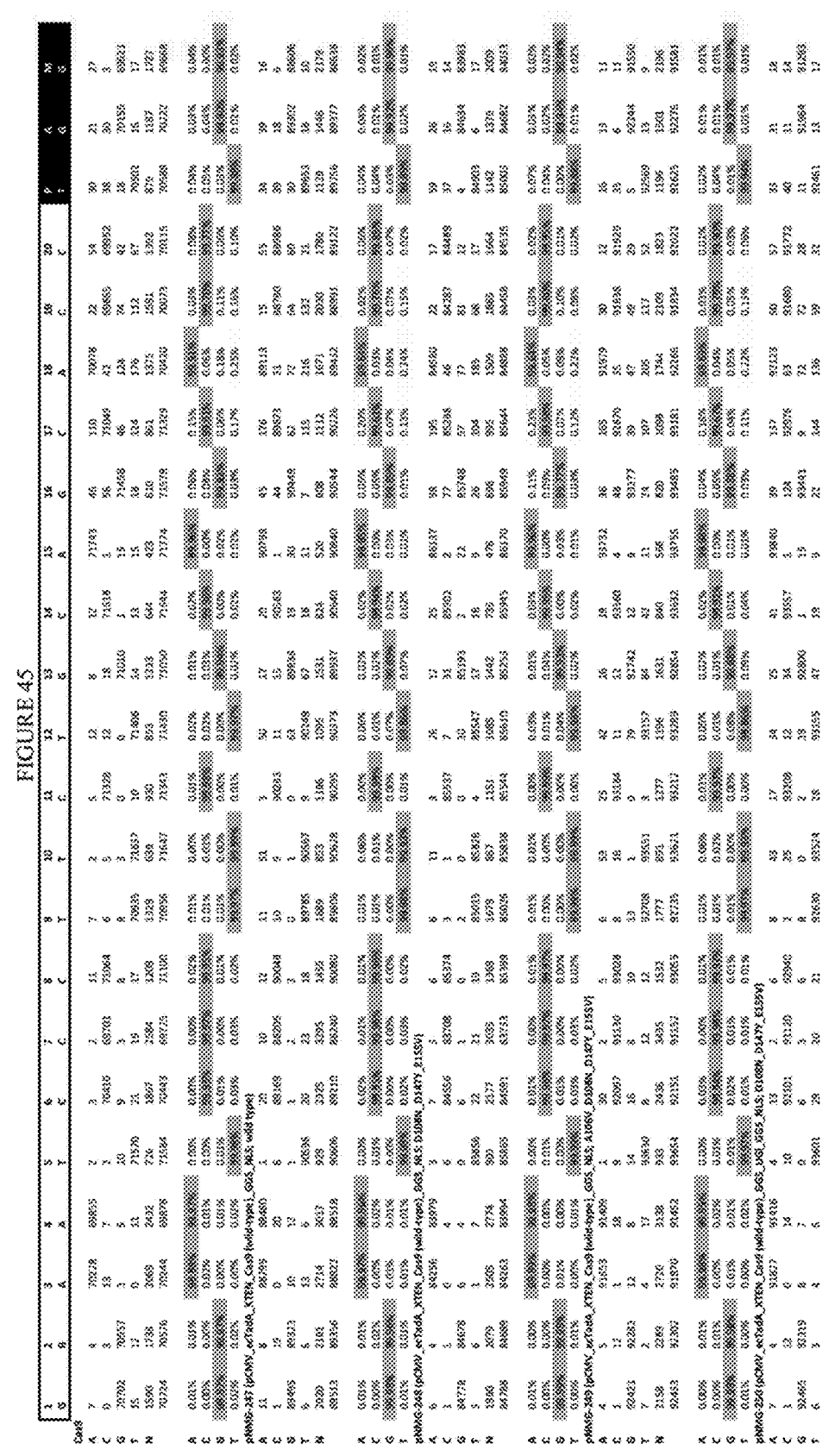
Figure 45:
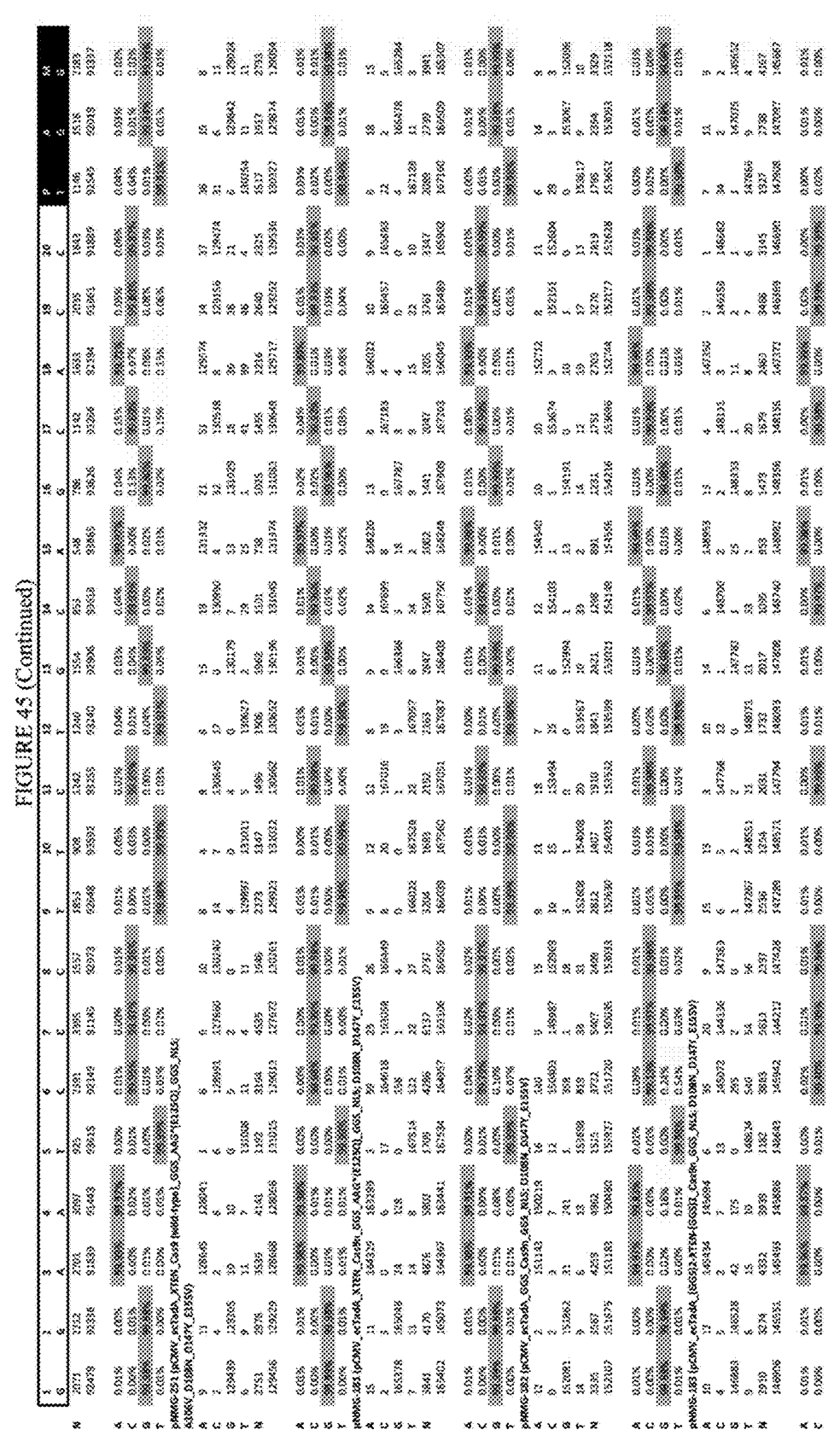
Figure 45:
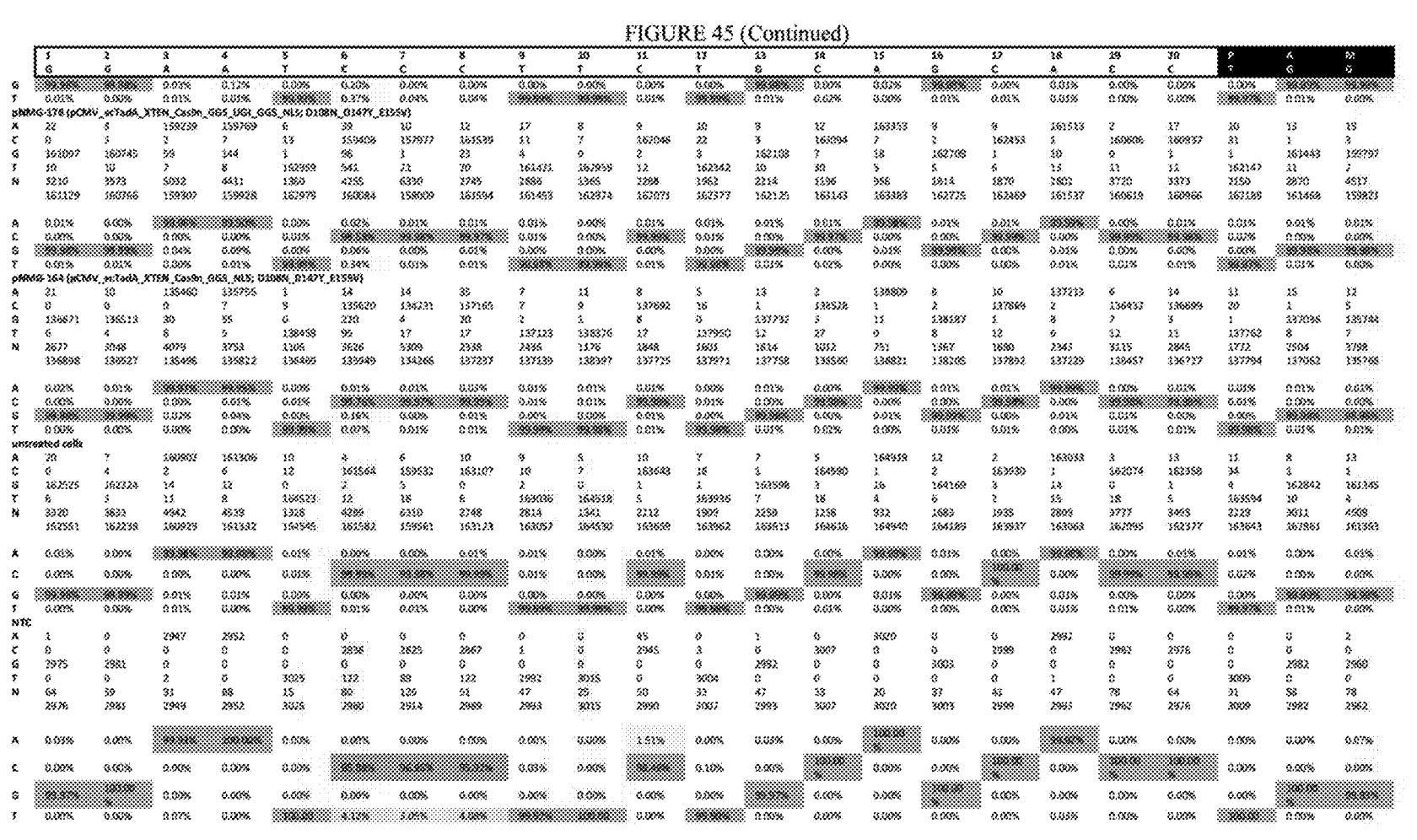
Figure 45:
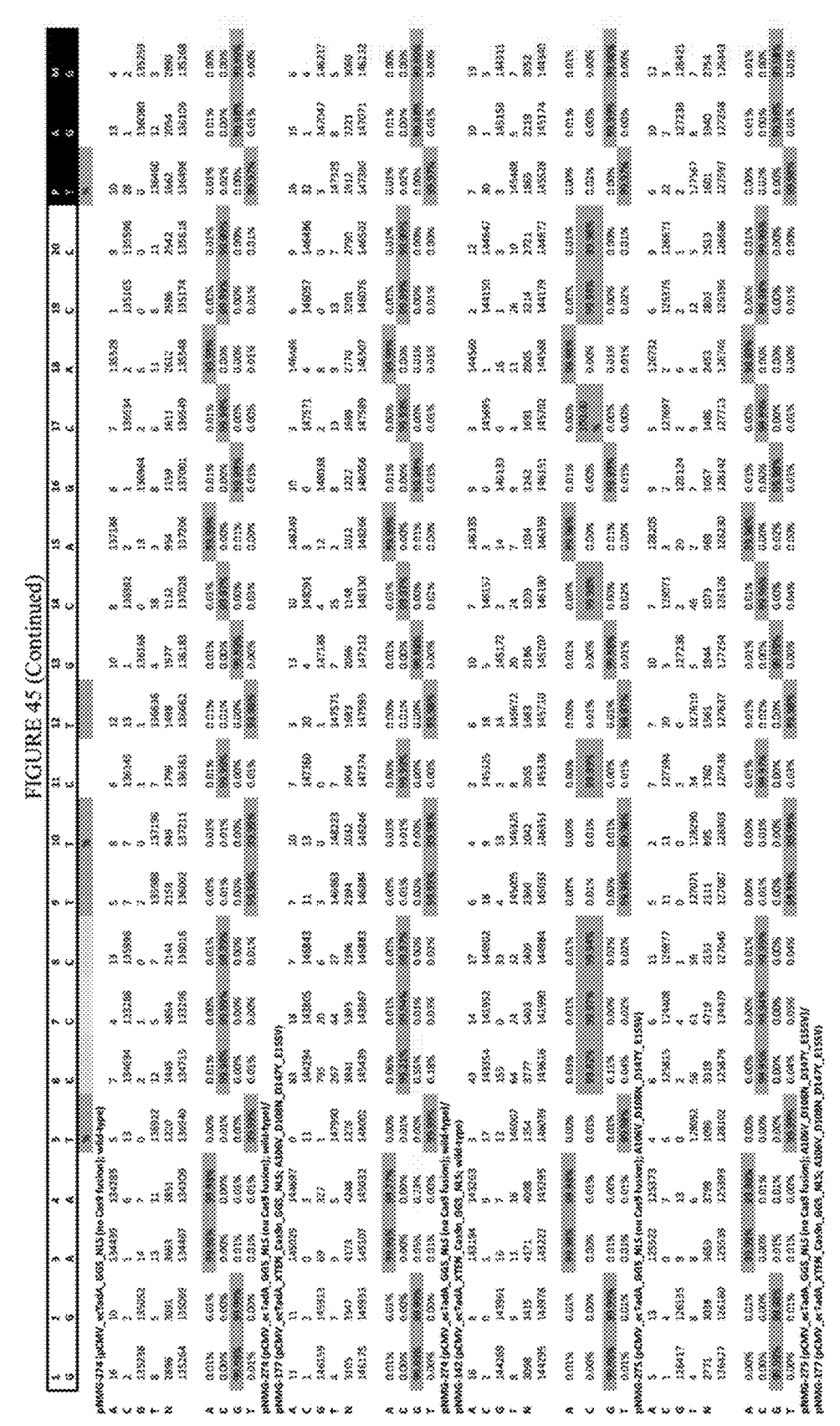
Figure 45:
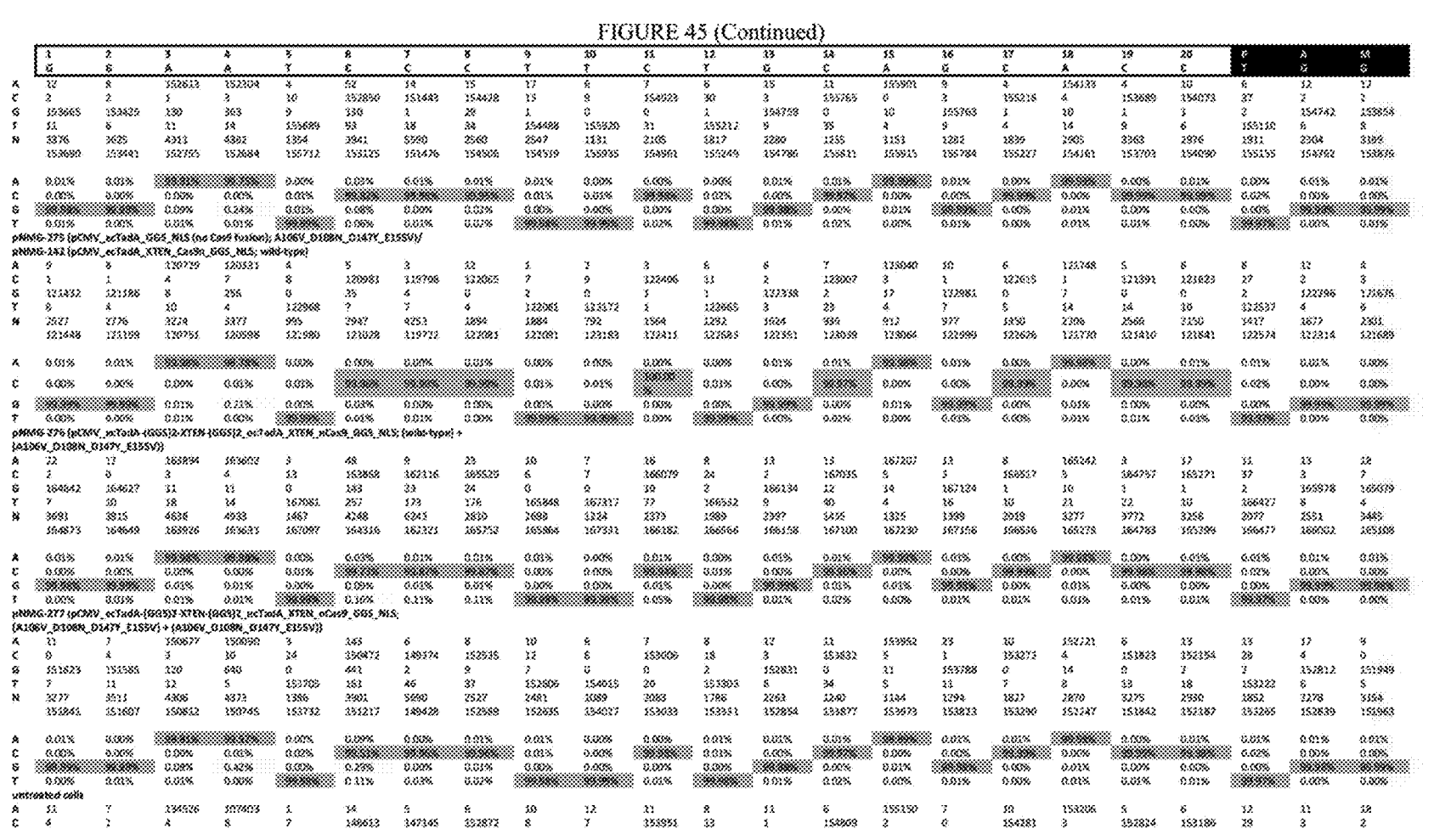
Figure 45:
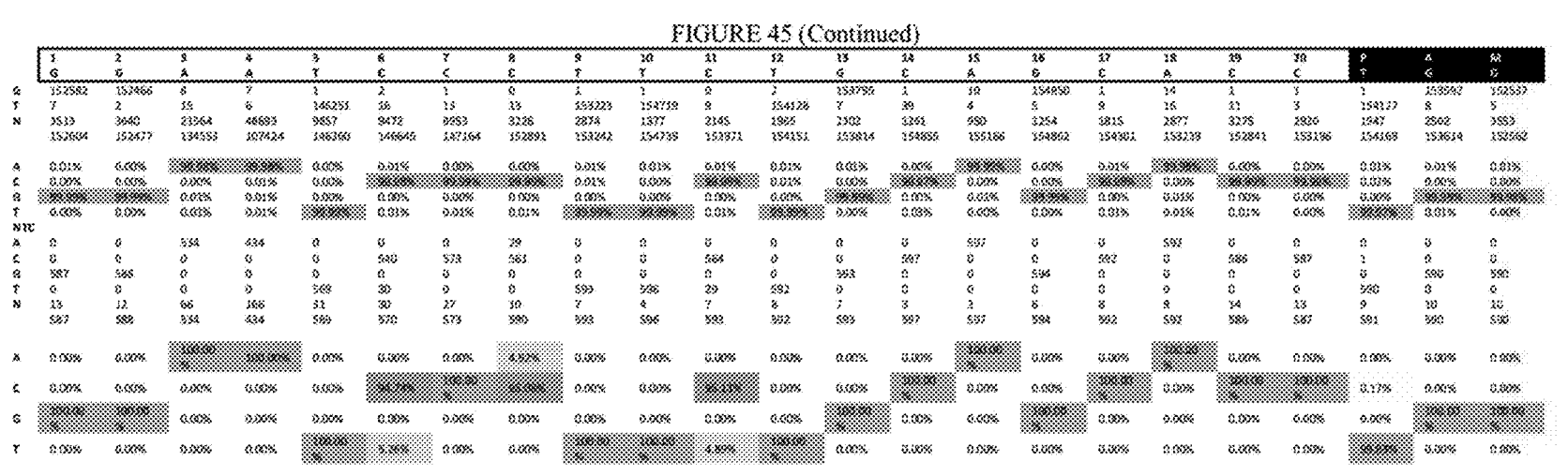

FIG. 45 shows the results of transfection at the FANCF site. The sequence corresponds to SEQ ID NO: 45.

FIG. 46 shows deaminase editing of sgRNA.

FIG. 47 shows constructs developed for fusions at various sites.

FIG. 48 shows indel rates for different fusions at various sites.

FIG. 49 shows the protospacer and PAM sequences of base editing sites set forth in SEQ ID NOs: 46, 45, 6, 42, 43, and 468 from top to bottom, respectively.

FIG. 50 shows constructs developed for fusions at various sites using further mutated D108 residue.

FIG. 52 shows the results of using mutated D108 residues to cause deaminase to reject RNA as a substrate and change the editing outcome.

FIG. 59 shows the importance of linker length on base editing function.

FIG. 60 shows the importance of linker length on base editing function.

FIG. 64 shows dimerization results from base editing.

FIG. 65 shows dimerization results from base editing.

FIG. 71 shows a HEK293 site 2 sequence. The sequence corresponds to SEQ ID NO: 360.

FIG. 72 shows the results of the first run with various edTadA mutations using the sequence of FIG. 71.

Figure 73:
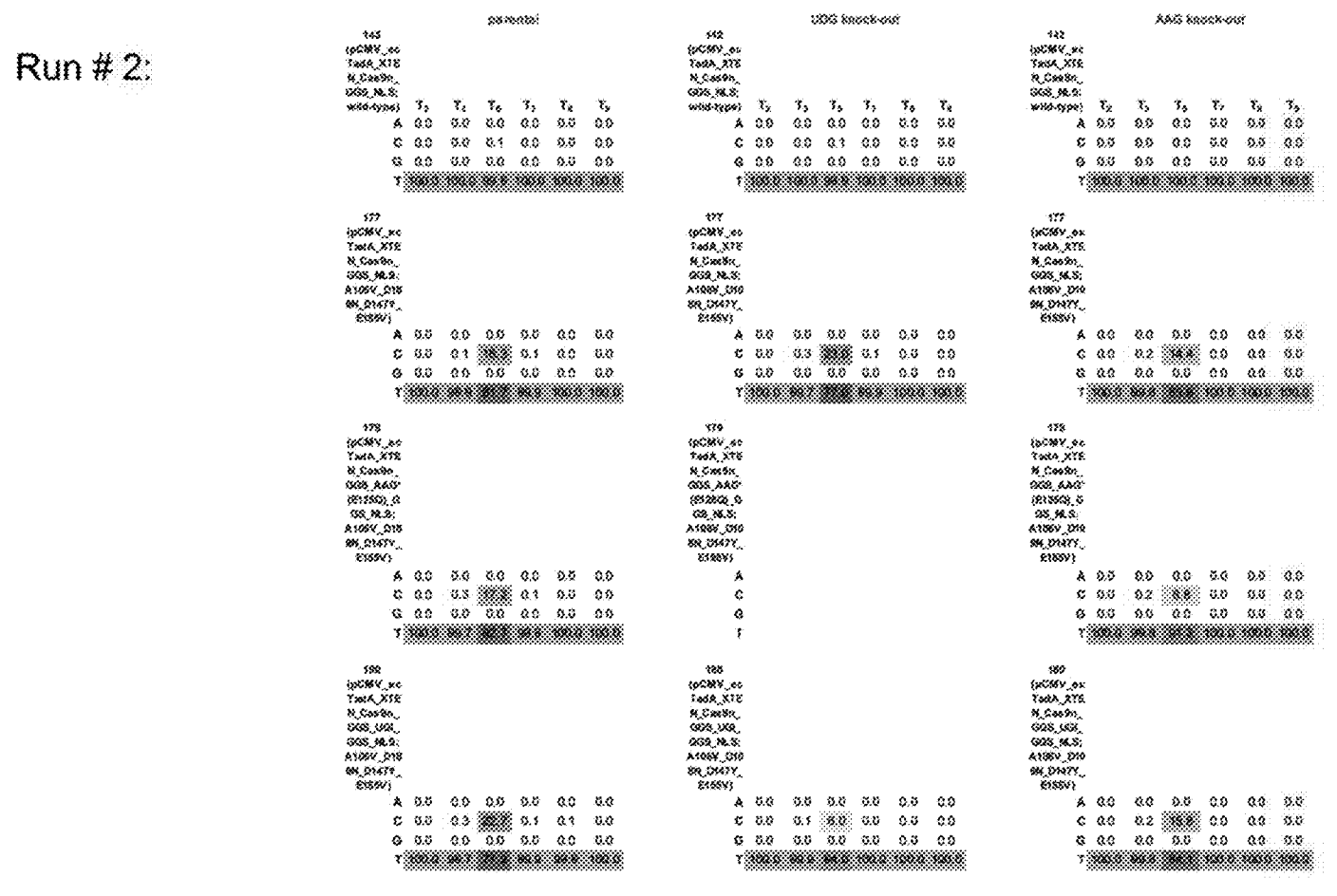

FIG. 73 shows the results of the second run with various edTadA mutations using the sequence of FIG. 71.

FIG. 74 shows a FANCF sequence. The sequence corresponds to SEQ ID NO: 45.

FIG. 75 shows the results of the second run using various edTadA mutations and the sequence of FIG. 74.

Figure 76:
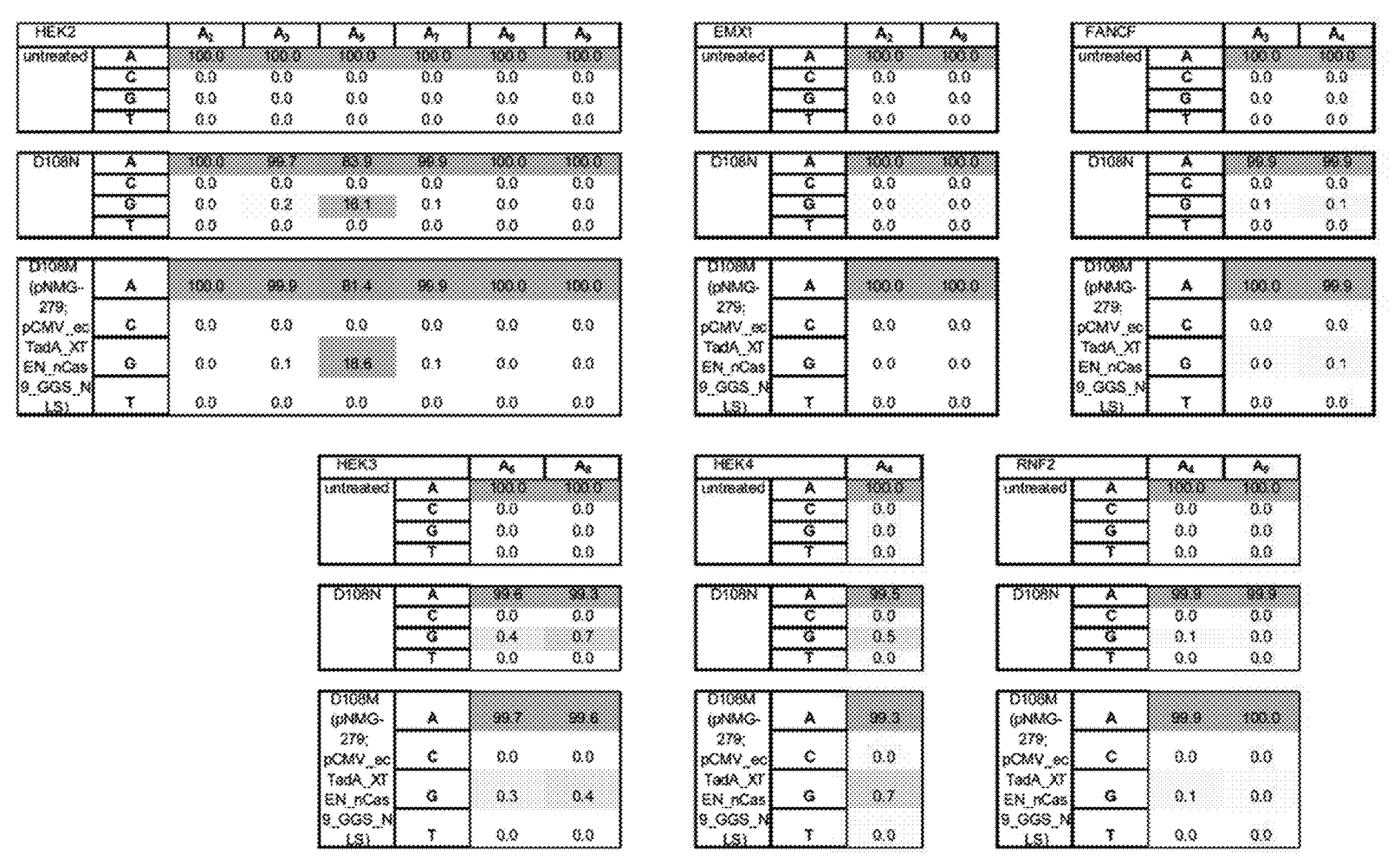

FIG. 76 shows the results of mutated D108 on all sites.

Figure 77:
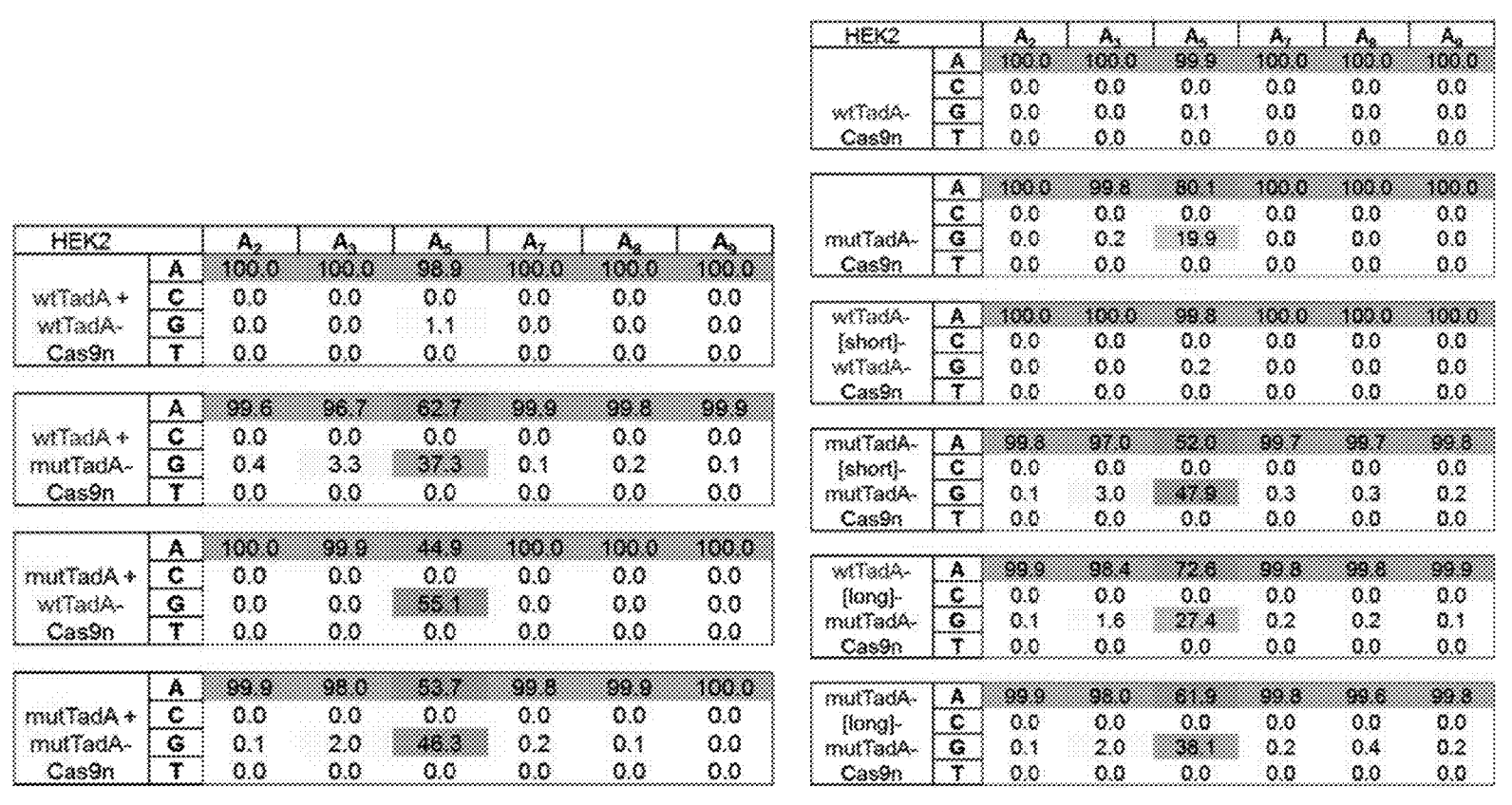

FIG. 77 shows in trans data from previous run (left panel) and the mut-mut fusions hindered by super long linkers.

Figure 78:
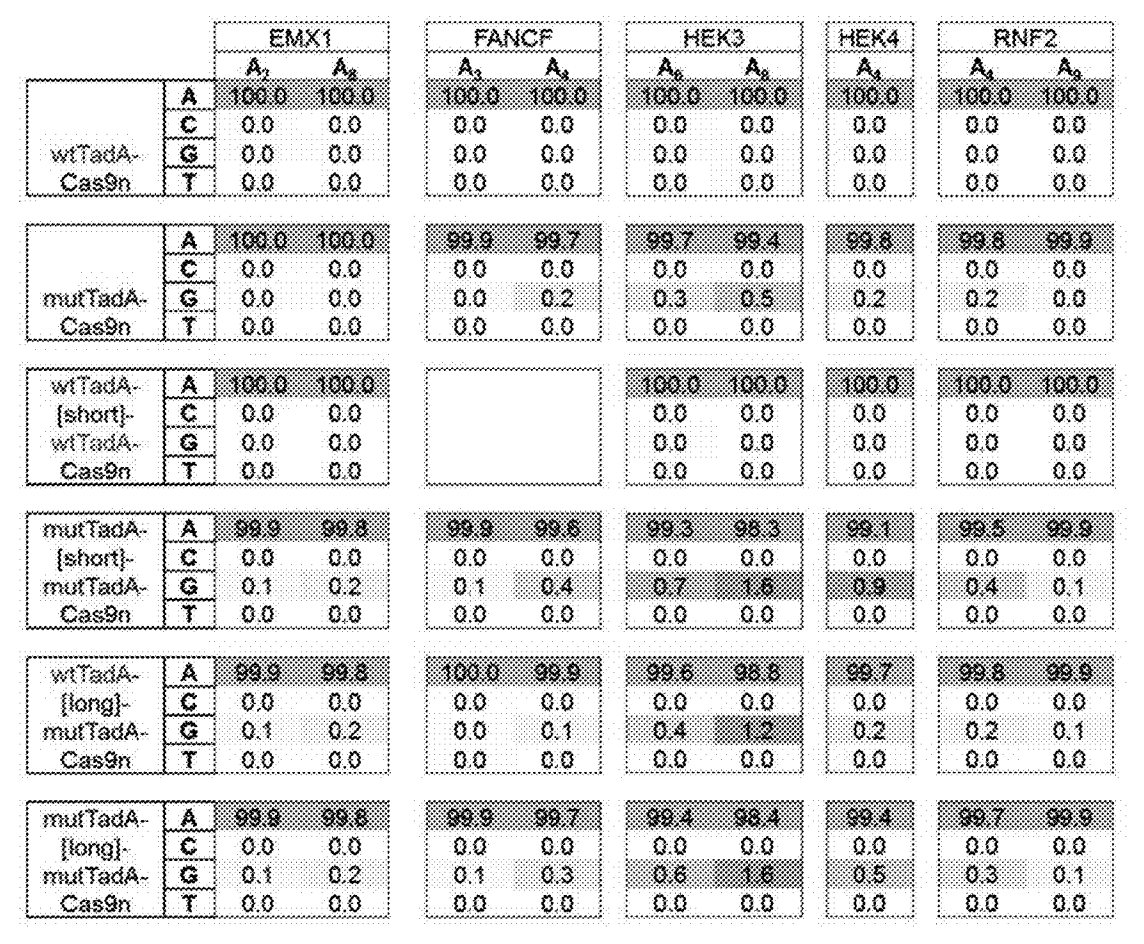

FIG. 78 shows the results of tethering mutTadA to ABE.

FIG. 86 shows the constructs used when tethering EndoV to ABE.

FIG. 87 is a schematic showing the tethering EndoV to ABE.

FIG. 88 shows the results of tethering EndoV to ABE.

FIG. 108 shows a summary of results of editing at the Hek-2 site. The Hek-2 sequence provided in the figure represents the reverse complement of SEQ ID NO: 41, which is the DNA strand where A to G editing takes place. The sequence corresponds to SEQ ID ID: 6.

FIG. 109 shows a summary of results of editing at the Hek2-3 site. The sequence corresponds to SEQ ID NO: 363.

FIG. 110 shows a summary of results of editing at the Hek2-6 site. The sequence corresponds to SEQ ID NO: 364.

FIG. 111 shows a summary of results of editing at the Hek2-7 site. The Hek2-7 sequence provided in the figure represents the reverse complement of the DNA strand where A to G editing takes place. The sequence corresponds to SEQ ID NO: 365.

FIG. 112 shows a summary of results of editing at the Hek2-10 site. The sequence corresponds to SEQ ID NO: 366.

Figure 113:
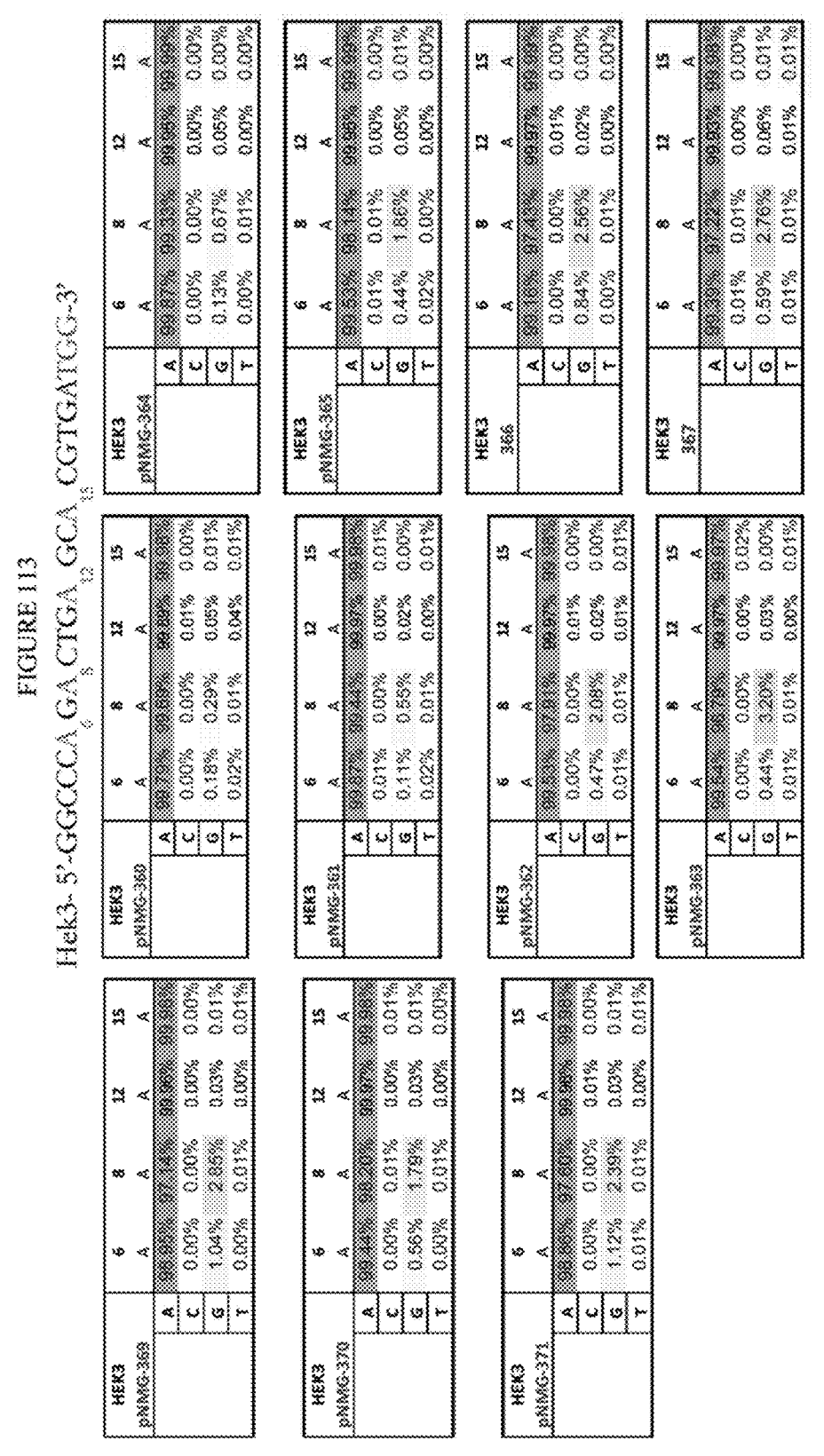

FIG. 113 shows a summary of results of editing at the Hek-3 site. The sequence corresponds to SEQ ID NO: 42.

Figure 114:
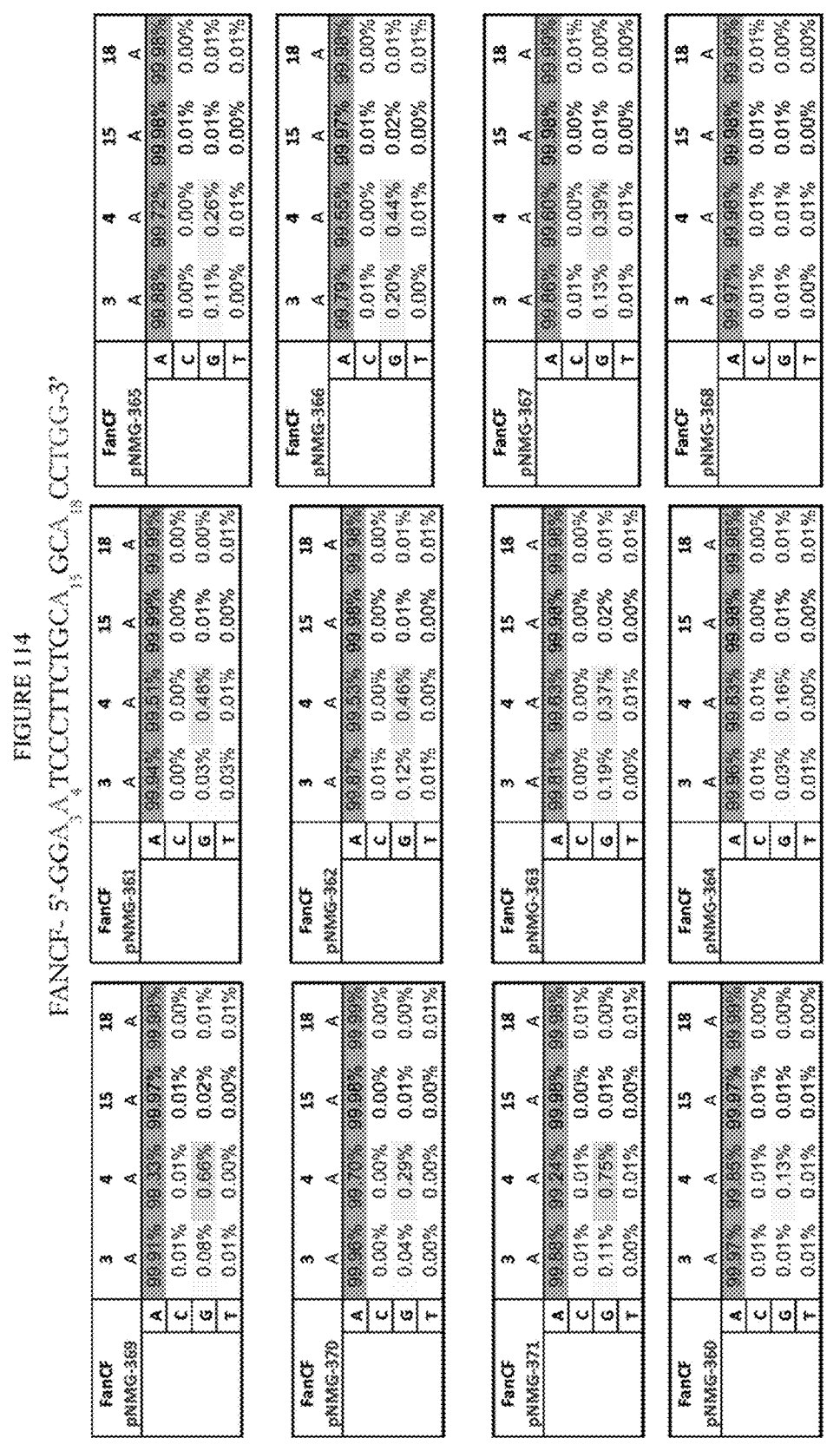

FIG. 114 shows a summary of results of editing at the FANCF site. The sequence corresponds to SEQ ID NO: 45.

FIG. 115 shows a summary of results of editing at the Hek-2 site. The sequence corresponds to SEQ ID NO: 367.

FIG. 116 shows a summary of results of editing at the Hek2-2 site. The sequence corresponds to SEQ ID NO: 368.

FIG. 117 shows a summary of results of editing at the Hek2-3 site. The sequence corresponds to SEQ ID NO: 363.

FIG. 118 shows a summary of results of editing at the Hek2-6 site. The sequence corresponds to SEQ ID NO: 364.

FIG. 119 shows a summary of results of editing at the Hek2-7 site. The sequence corresponds to SEQ ID NO: 365.

FIG. 120 shows a summary of results of editing at the Hek2-10 site. The sequence corresponds to SEQ ID NO: 366.

FIG. 121 shows a summary of results of editing at the Hek-3 site. The sequence corresponds to SEQ ID NO: 42.

FIG. 122 shows a summary of results of editing at the FANCF site. The sequence corresponds to SEQ ID NO: 45.

Figures 123, 124:

FIG. 123 shows the results of ecTadA evolution (evolution #4) at HEK2, HEK2-2, HEK2-3, HEK2-6, HEK2-7, and HEK2-10 sites. The constructs used were pNMG-370 (evolution #2), pNMG-371 (evolution #3), and pNMG 382-389 (evolution #4). The sequences correspond to SEQ ID NOs: 7, 368, 363, 364, 369, and 370 from top to bottom, respectively.

FIG. 124 shows a schematic of a construct containing ecTadA and dCas9 used for ecTadA evolution (evolution #5).

FIG. 125 is a table showing the results of clones assayed after fifth round evolution (128 ug/mL chlor, 7 h).

Figures 126A, 126B:
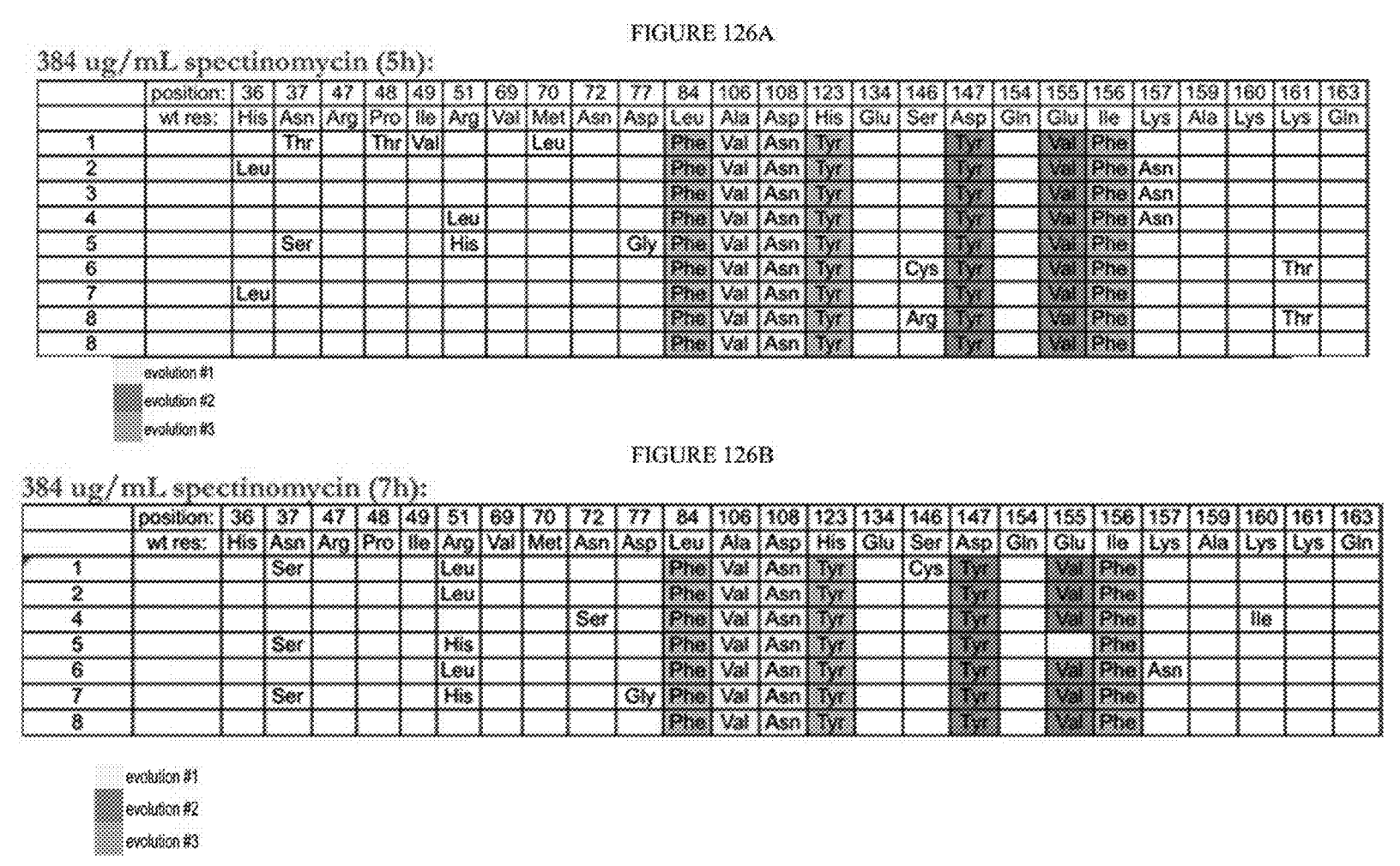
Figures 126C, 126D:
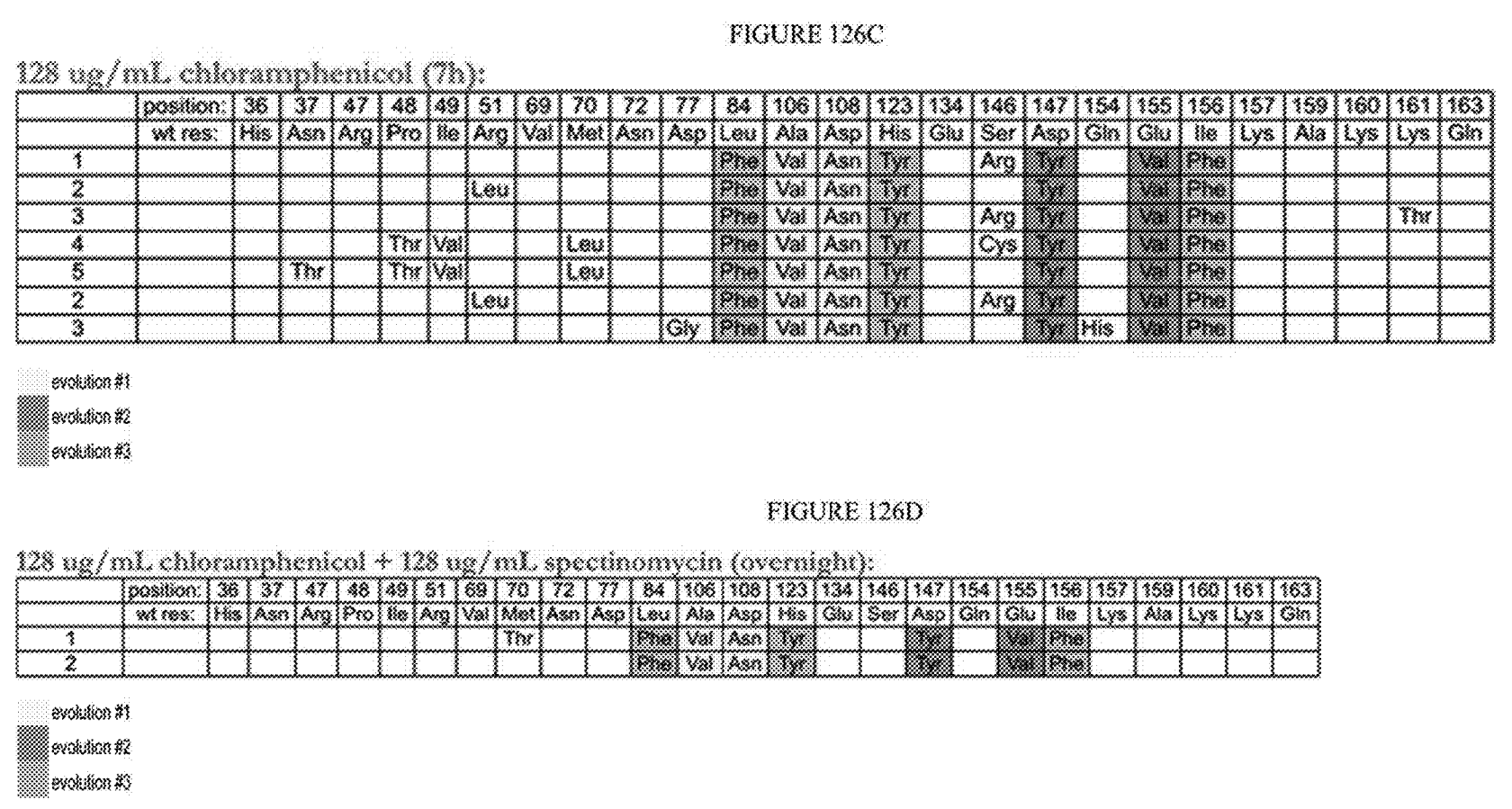

FIGS. 126A to 126E are tables showing the results of sub-cloned and re-transformed clones assayed after fifth round under varying conditions.

Figures 126E, 127:
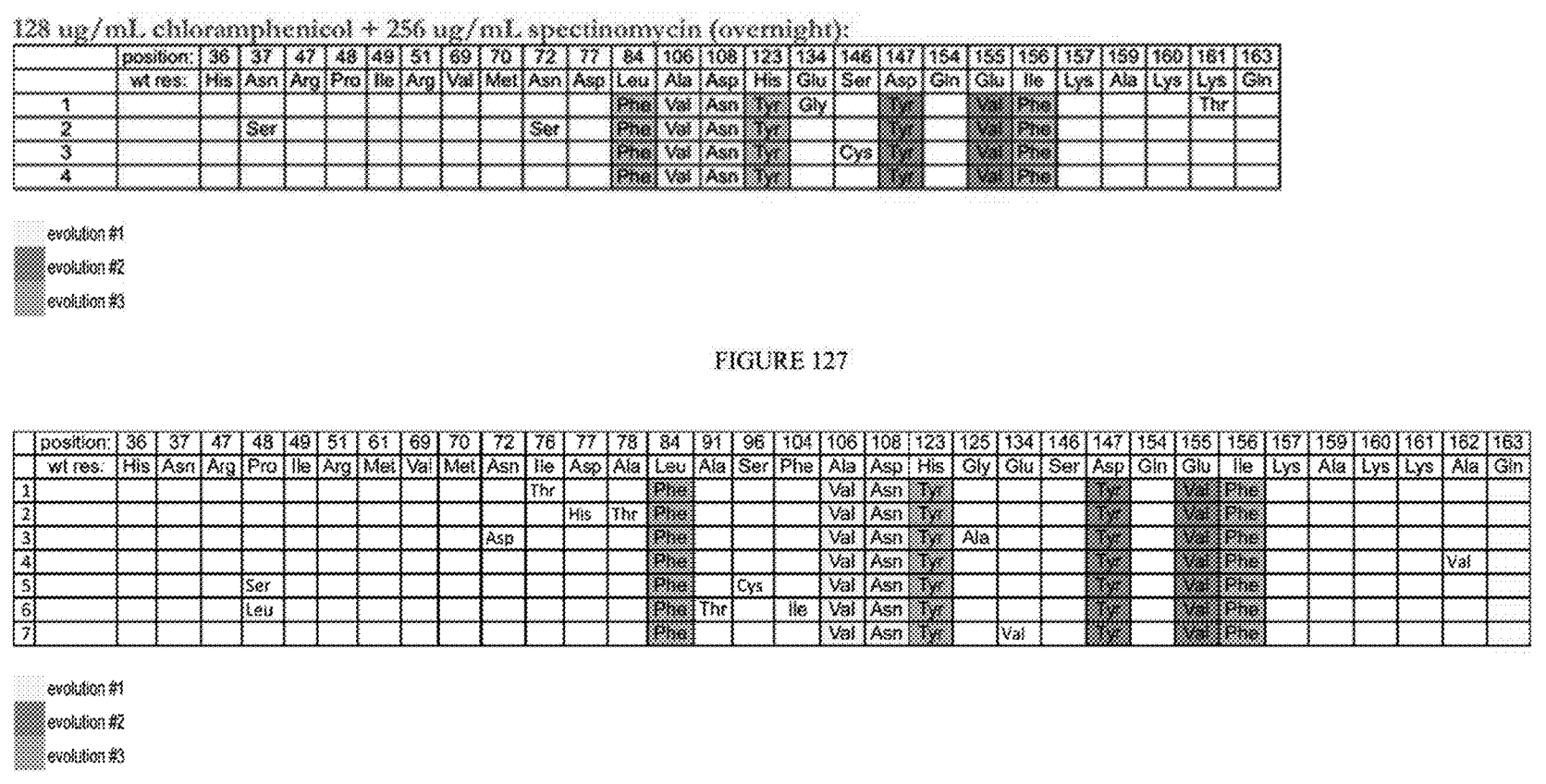

FIG. 127 is a table showing the results of amplicons from spectinomycin selection clones assayed after fifth round evolution.

Figure 128:
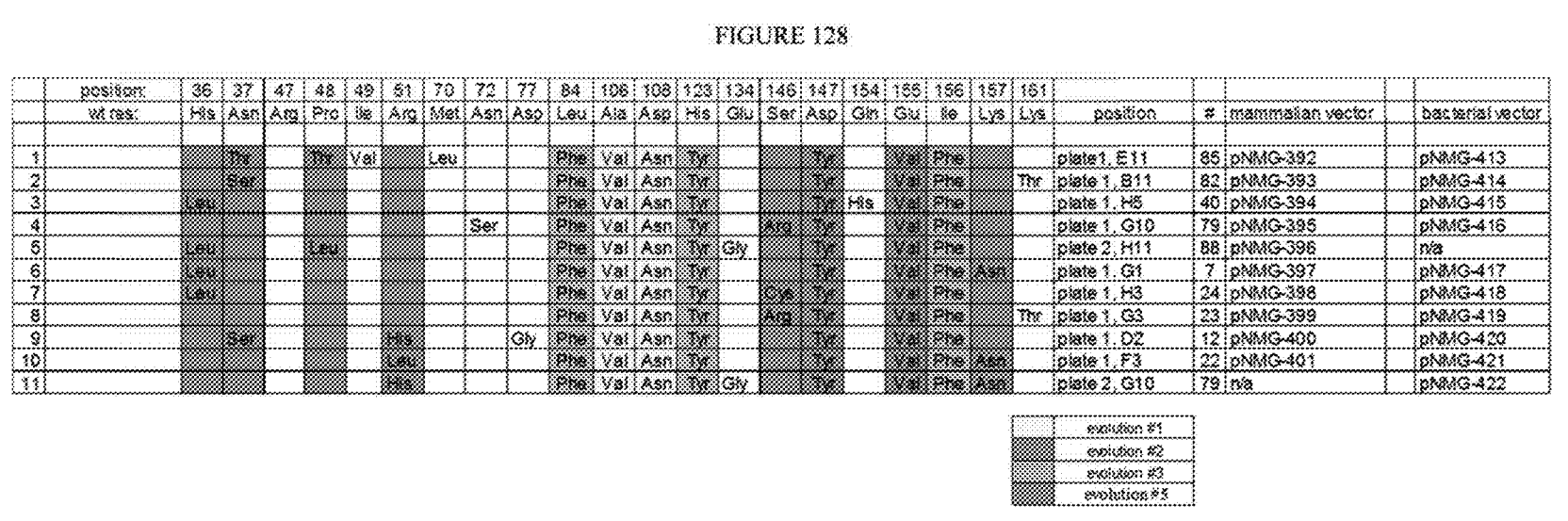

FIG. 128 is a table showing the results of clones assayed after fifth round evolution.

FIG. 129 shows a summary of results of editing at the Hek-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 6.

FIG. 130 shows a summary of results of editing at the Hek2-1 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-1 sequence provided in the figure represents the DNA strand where A to G editing takes place. The sequence corresponds to SEQ ID NO: 465.

FIG. 131 shows a summary of results of editing at the Hek2-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 368.

FIG. 132 shows a summary of results of editing at the Hek2-3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 363.

FIG. 133 shows a summary of results of editing at the Hek2-4 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-4 sequence provided in the figure represents the DNA strand where A to G editing takes place. The sequence corresponds to SEQ ID NO: 466.

FIG. 134 shows a summary of results of editing at the Hek2-6 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 364.

FIG. 135 shows a summary of results of editing at the Hek2-9 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-9 sequence provided in the figure represents the DNA strand where A to G editing takes place. The sequence corresponds to SEQ ID NO: 467.

FIG. 136 shows a summary of results of editing at the Hek2-10 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-10 sequence provided in the figure represents the DNA strand where A to G editing takes place. The sequence corresponds to SEQ ID NO: 370.

FIG. 137 shows a summary of results of editing at the Hek3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 42.

FIG. 138 shows a summary of results of editing at the RNF2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 468.

FIG. 139 shows a summary of results of editing at the FANCF site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 45.

Figure 140:
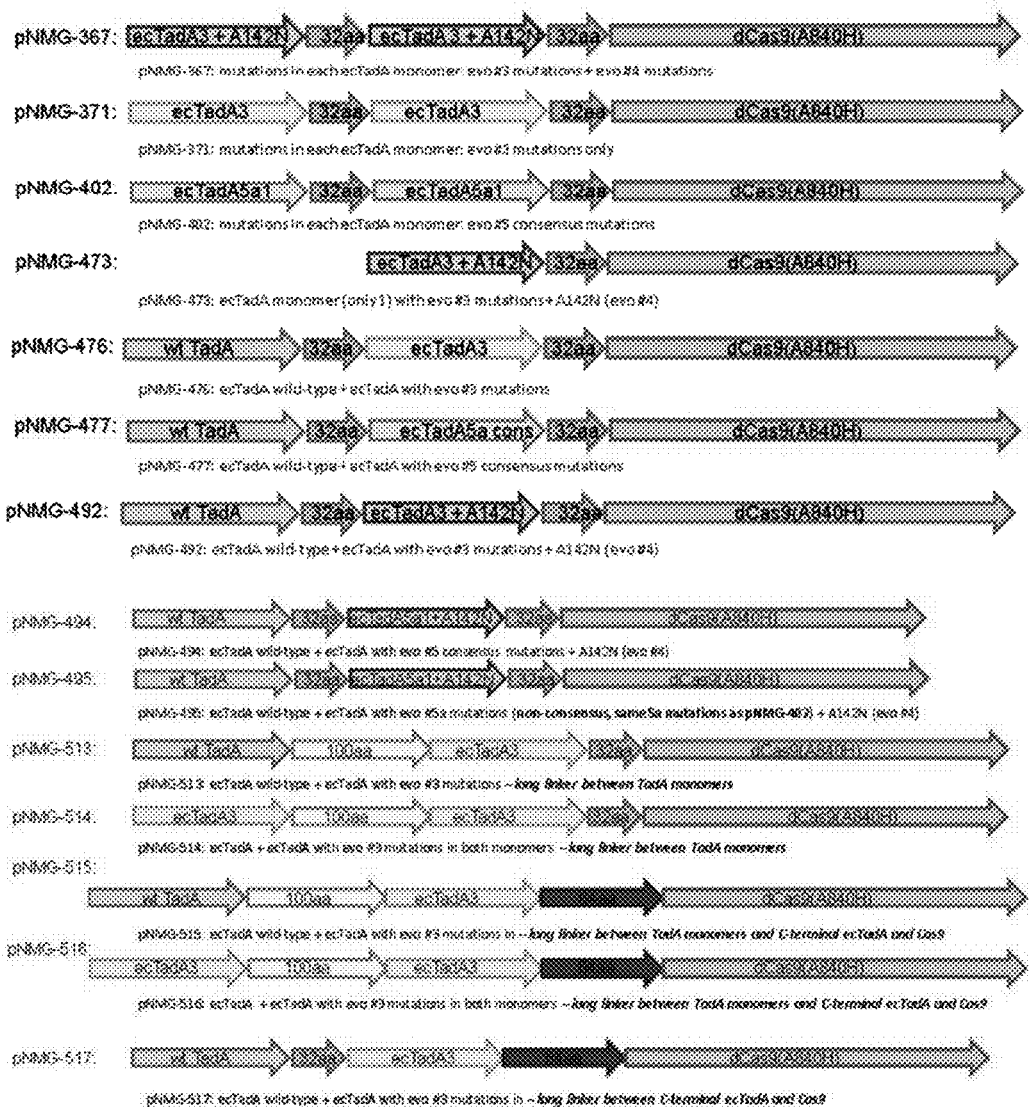
Figure 140:
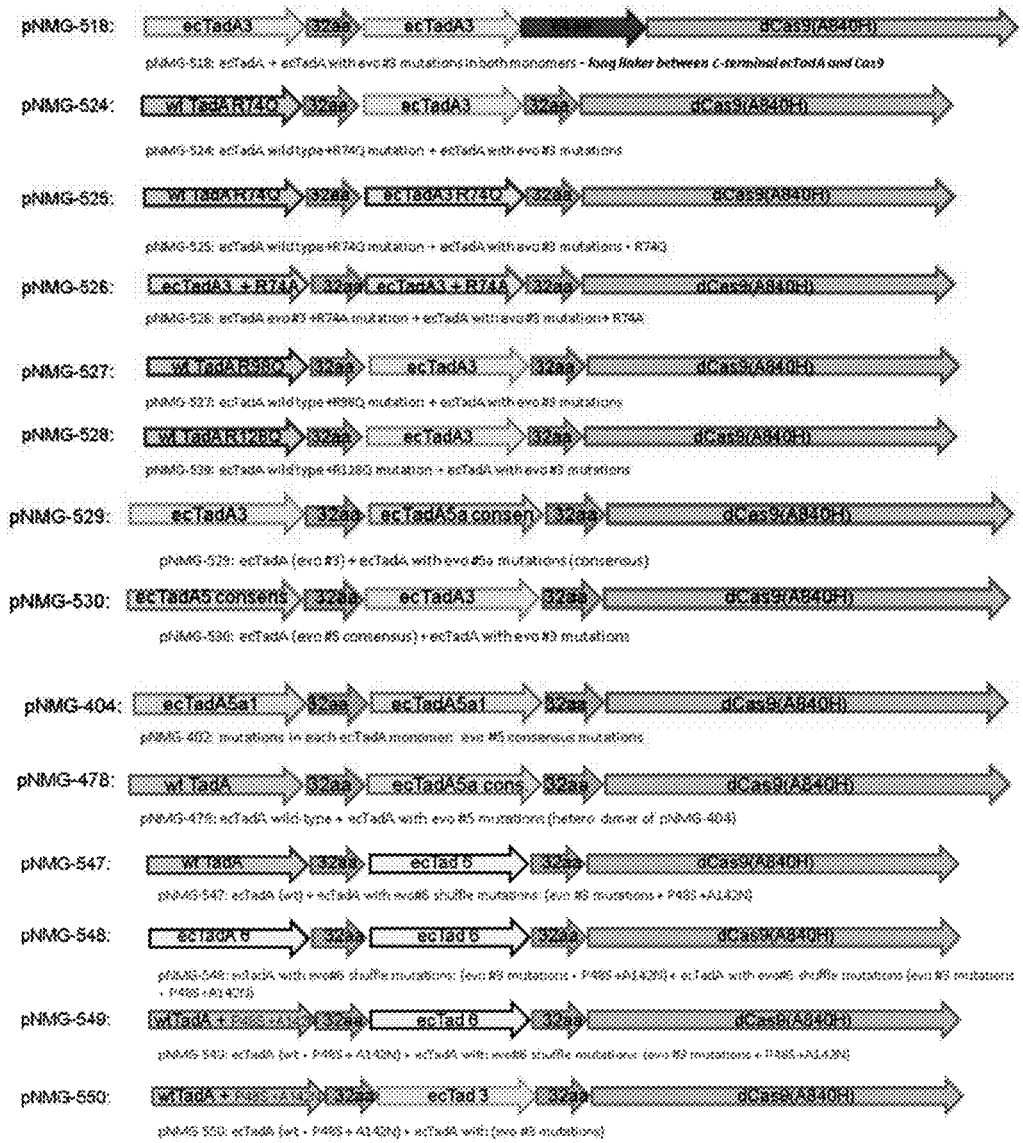
Figure 140:
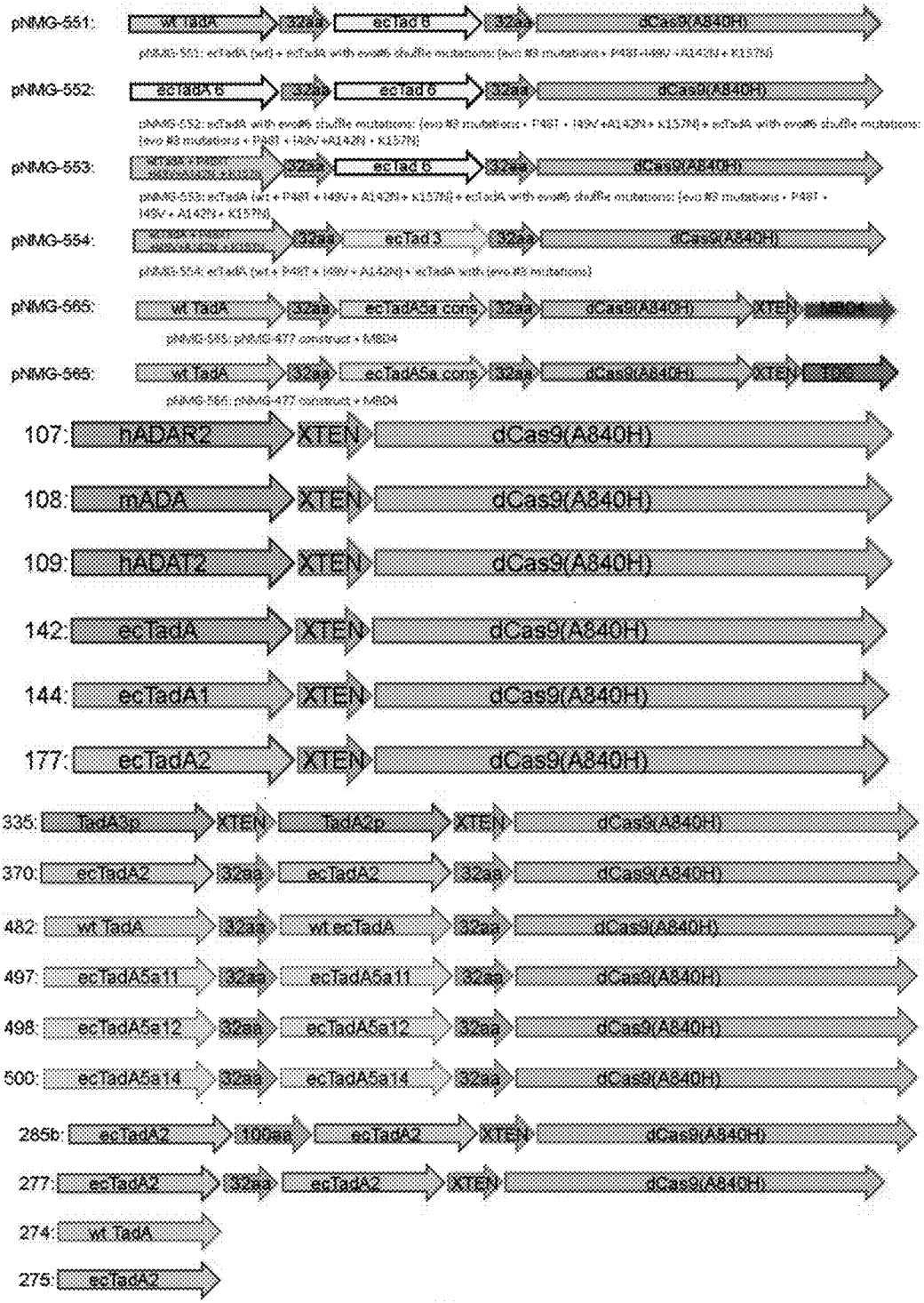
Figure 140:
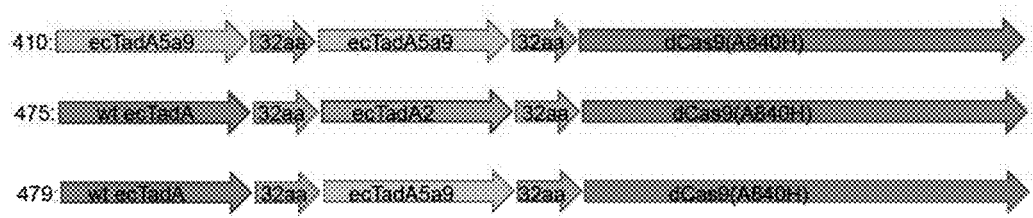

FIG. 140 shows various schematic representations of adenosine base editor (ABE) constructs. The identity of the editors e.g., "pNMG-367" is indicated in Table 4. The following mutations are abbreviated as follows: ecTadA1 (A106V D108N), ecTadA2 (A106V D108N D147Y E155V), ecTadA3 (ecTadA2+L84F H123Y I156F), ecTadA3+(ecTadA3+A142N), ecTadA5a1 (ecTadA3+H36L R51L S146C K157N), ecTadA5a3 (ecTadA3+N37S K161T), ecTadA5a11 (ecTadA3+R51L S146C K157N K161T), ecTadA5a12 (ecTadA3+S146C K161T), ecTadA5a14 (ecTadA3+RS146C K157N K160E), and ecTadA5a1+(ecTadA5a1+A142N), ecTadA5a9 (ecTadA3+ S146R K161T). Heterodimers of the top three ABE 5a constructs were made and then tested relative to homodimers. The heterodimer version of the ABE editor typically performs better than the corresponding homodimeric construct. Both homodimeric and heterodimeric constructs are shown in FIG. 140.

Figure 141:
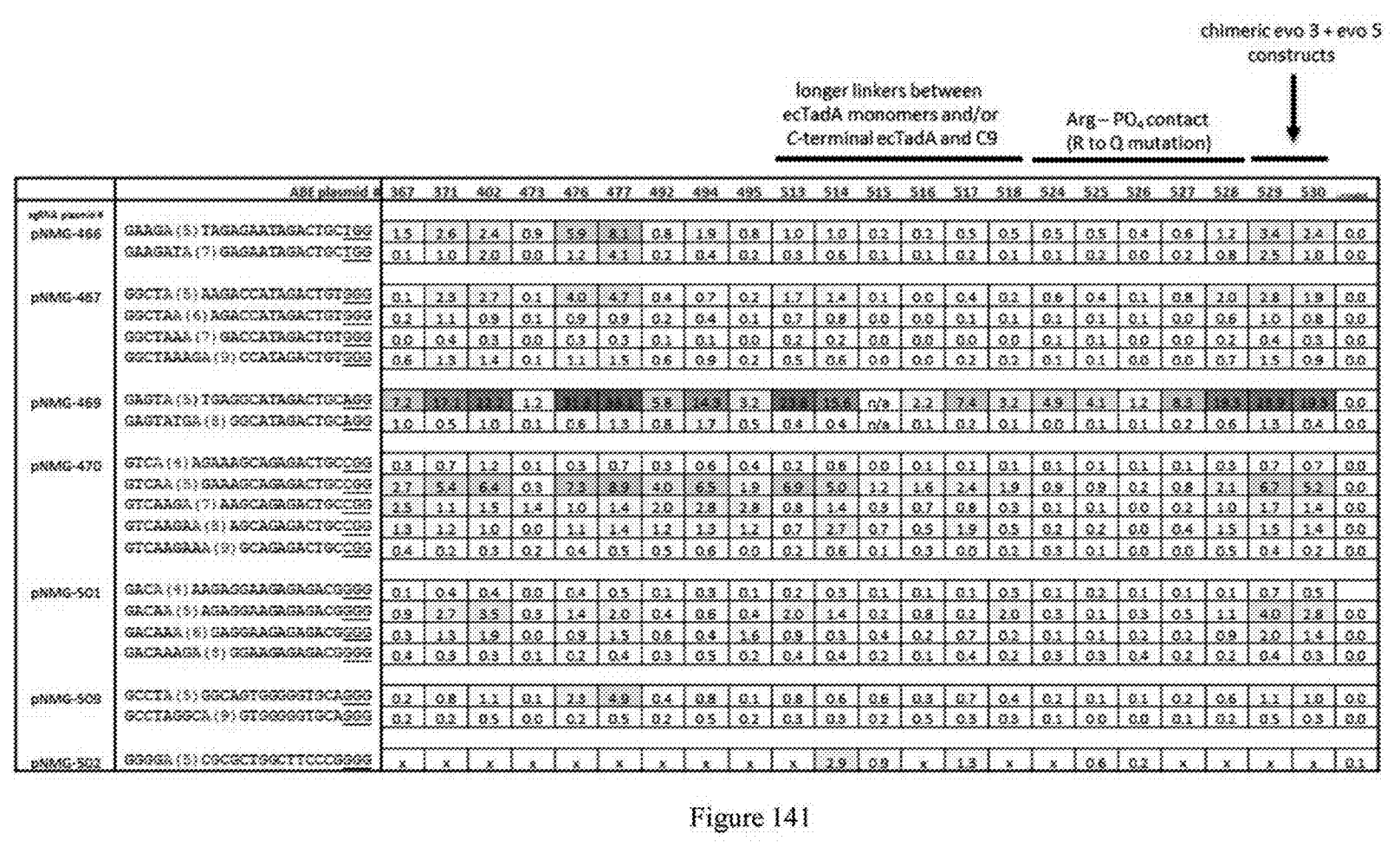

FIG. 141 shows editing results for various ABE constructs. The ABE plasmid # refers to pNMG number as indicated in Table 4. For example 367 refers to construct pNMG-367 in Table 4. The sequences correspond to SEQ ID NOs: 469 (pNMG-466), 470 (pNMG-467), 471 (pNMG-469), 472 (pNMG-470), 473 (pNMG-501), 474 (pNMG-509), and 475 (pNMG-502) from top to bottom, respectively.

Figure 142:
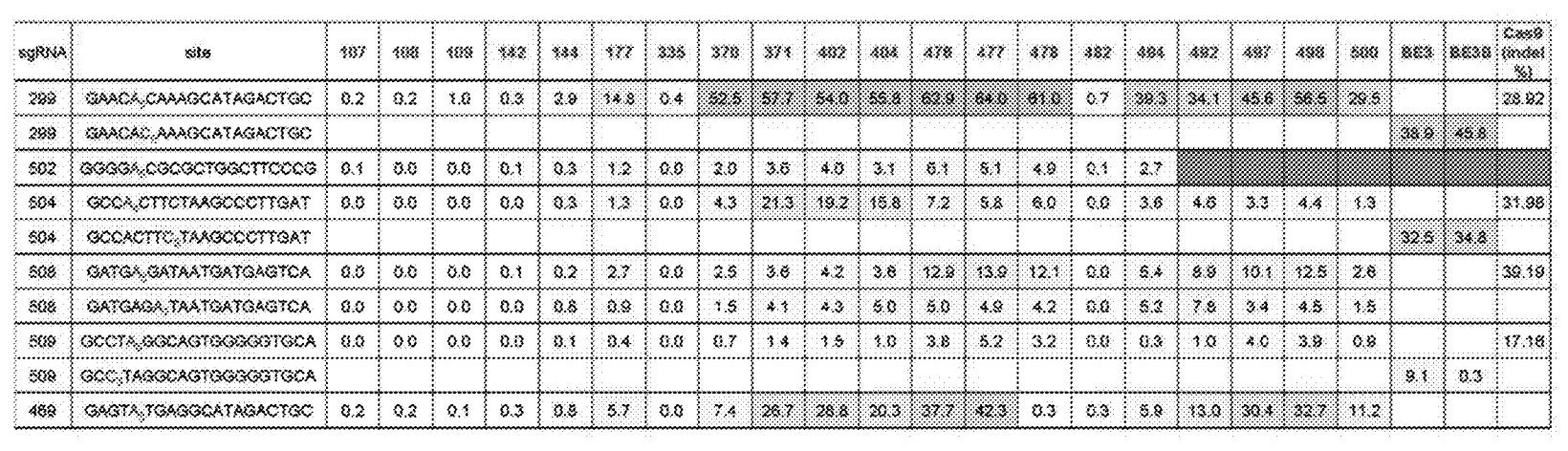

FIG. 142 shows editing results for various ABE constructs at specific sites. The numbers on the top row indicate the pNMG number as indicated in Table 4. For example 107 refers to construct pNMG-107 in Table 4. In certain contexts, homodimer constructs have been shown to work better than a hetero dimer construct and vice versa (see for example construct 371 which is a homodimer versus construct 476 which is a heterodimer). Schematics for these ABE constructs are shown in FIG. 140, and the construct architecture is shown in Table 4. The sequences correspond to SEQ ID NOs: 478, 478, 514, 516, 516, 520, 520, 521, 521, and 509 from top to bottom, respectively.

FIG. 143 shows the percentage of indels formed for ABE constructs from FIG. 142.

FIG. 144 shows editing results for various ABE constructs at specific sites. The identity of the constructs are shown in the top row and refer to the pNMG reference number of Table 4. The results in FIG. 144 indicate that adding ecTadA monomer to ABE construct may not improve editing. However, adding a long linker between monomers may help editing at some sites (see, for example, the editing results for sgRNA constructs 285b versus 277 at sites 502, 505, 507). The identity of the sgRNA constructs is shown in Table 8 Schematics for these ABE constructs are shown in FIG. 140. The sequences correspond to SEQ ID NOs: 478, 480, 480, 514, 517, 517, 517, 517, 519, and 521 from top to bottom, respectively.

FIG. 145 shows results for ABE constructs at all NAN sites, where the target A is at position 5 of the Protospacer and PAM sequnces. The identity of the ABE constructs, shown in the top row refers to the pNMG reference number in Table 4. The number values represent the % of target A residues that were edited (e.g., % editing efficiency). The sequences correspond to SEQ ID NOs: 537-552 from top to bottom, respectively.

Figure 146:
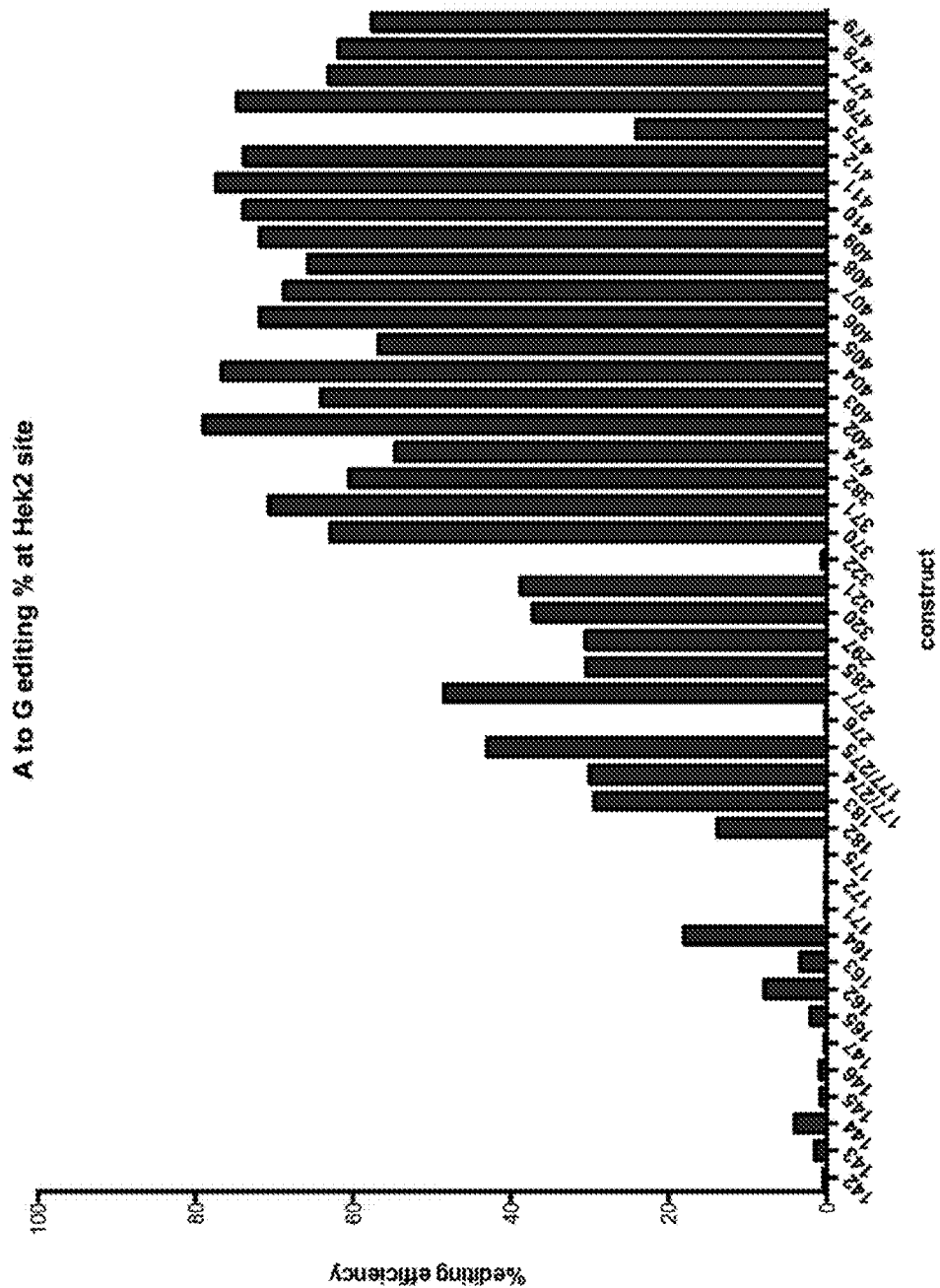

FIG. 146 shows A to G editing percent at the Hek2 site for various ABE constructs as referenced by their reference pNMG number in Table 4.

FIG. 147 shows evolution round #5b evolution results. The number values represent the % of A to G editing for the indicated sites. The sequences from top to bottom correspond to SEQ ID NOs: 7, 465, 368, 363, 364, and 370 from top to bottom, respectively.

Figure 148:
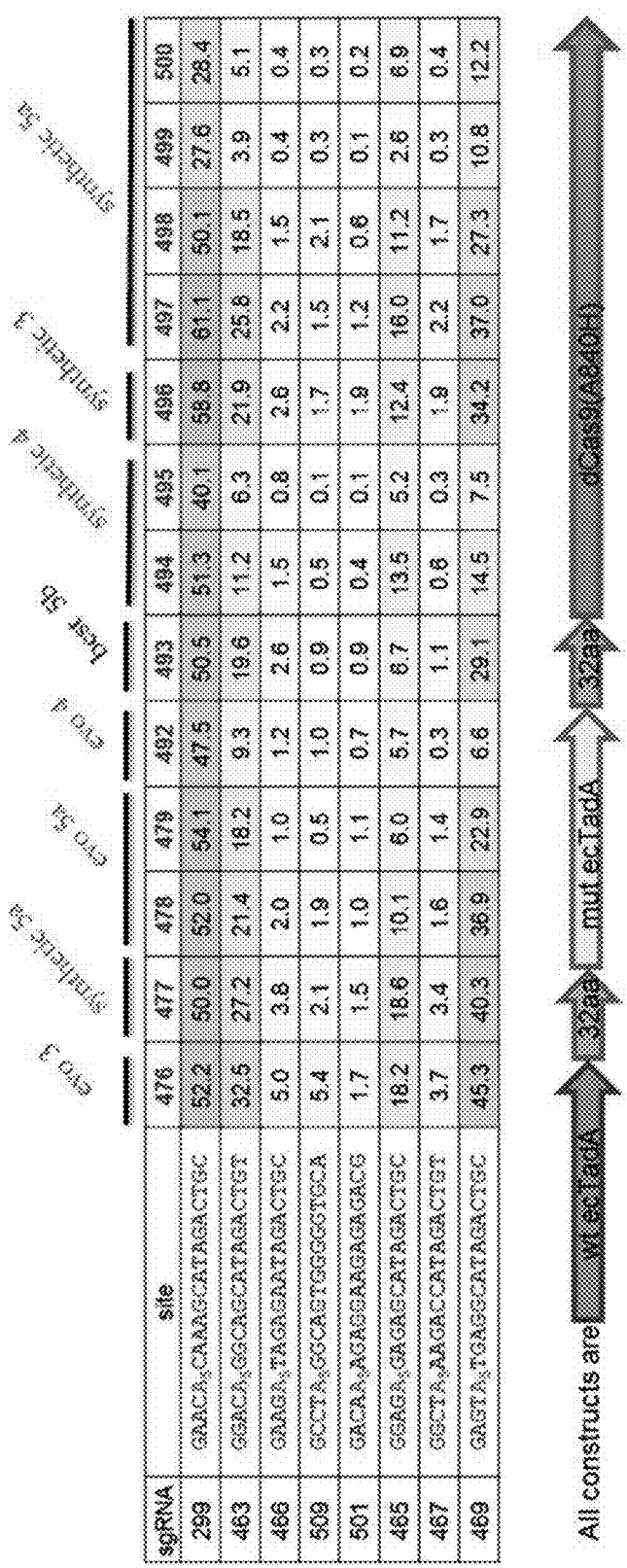

FIG. 148 shows editing results for various ABE constructs which were obtained from different rounds of evolution (e.g., evo3). The generic schematic for the ABE constructs is also shown. The identity of the sgRNA, as indicated in Table 8, and the identity of the base editors (pNMG reference), as indicated in Table 4, are shown. The number values represent the % of A to G editing for the indicated sites. The sequences correspond to SEQ ID NOs: 478, 503, 506, 521, 513, 505, 507, and 509 from top to bottom, respectively.

FIG. 149 shows examination of the ABE constructs at genomic sites other than the Hek-2 sequence. The Hek-2 site (sgRNA 299) is represented by the asterisk. The identity of the sgRNA is indicated in Table 8. The sequences correspond to SEQ ID NOs: 478, 514, 516, 517, 517, 517, 517, 519, 520, 529, 521 from top to bottom, respectively.

Figure 150:
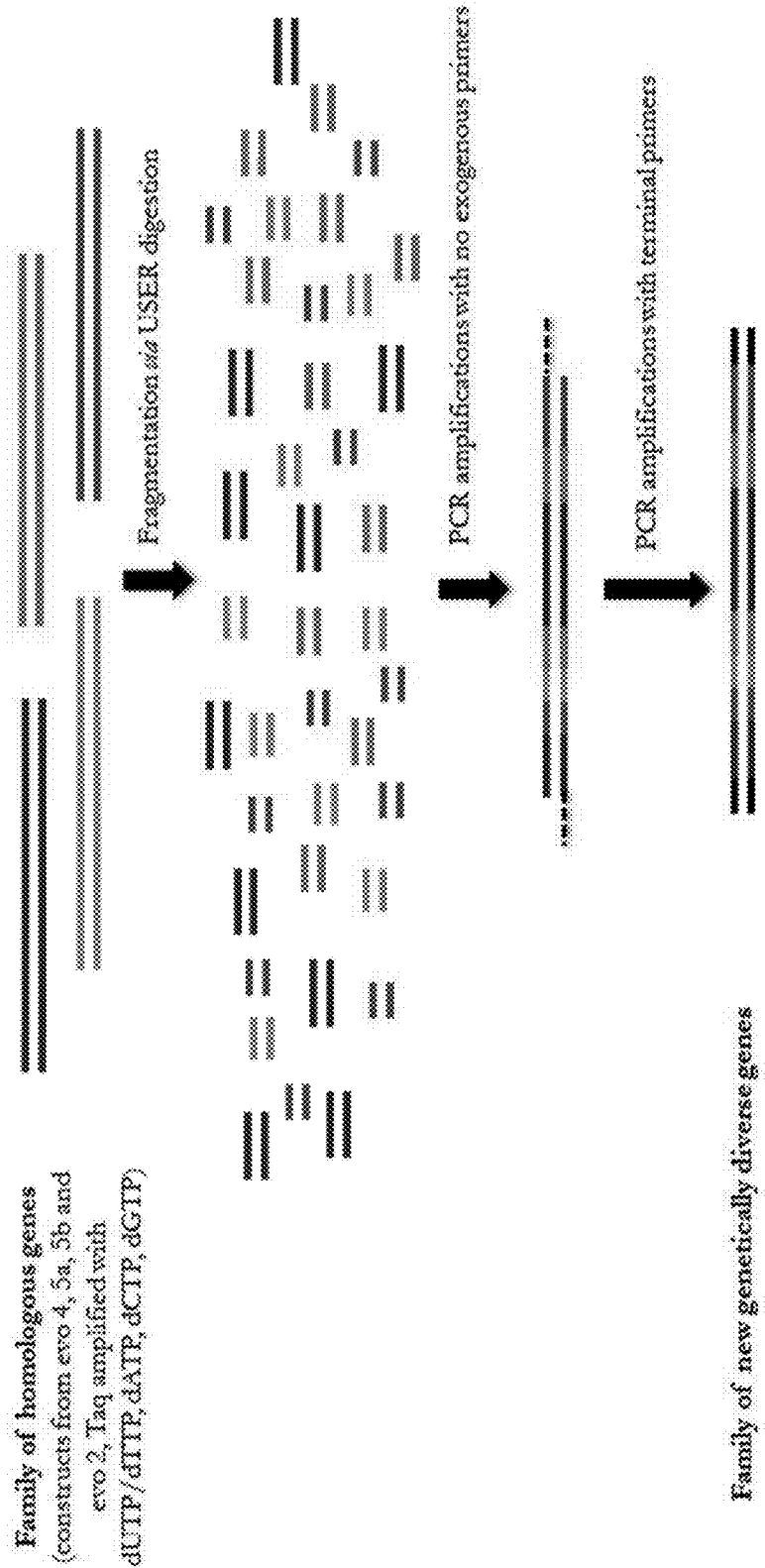

FIG. 150 shows a schematic of the DNA shuffling experiment using nucleotide exchange and excision technology (NExT), which is referred to as ABE evolution #6. The goal of this approach was to assemble a more efficient editor and remove potential epistatic mutations. DNA shuffling of constructs from various evolutions were used to optimize for desired mutations and eliminate mutations that negatively affect editing efficiencies and/or protein stability.

Figure 151:
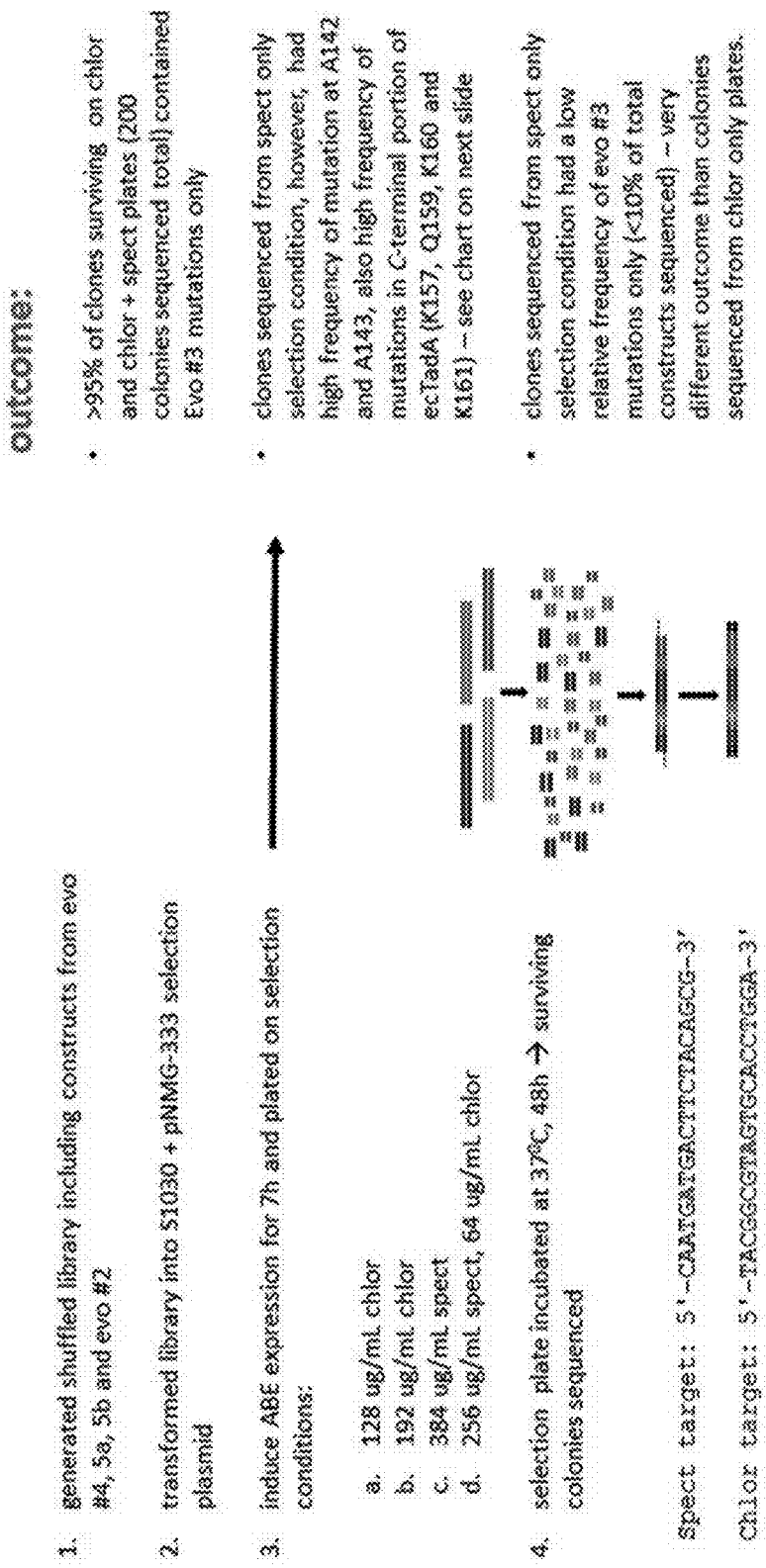

FIG. 151 shows a schematic for DNA Shuffle (NeXT). The spect target sequence is 5'-CAATGATGACTTCTACA-GCG-3' (SEQ ID NO: 444) and the chlor target sequence is 5'-TACGGCGTAGTGCACCTGGA-3' (SEQ ID NO: 441).

Figure 152:
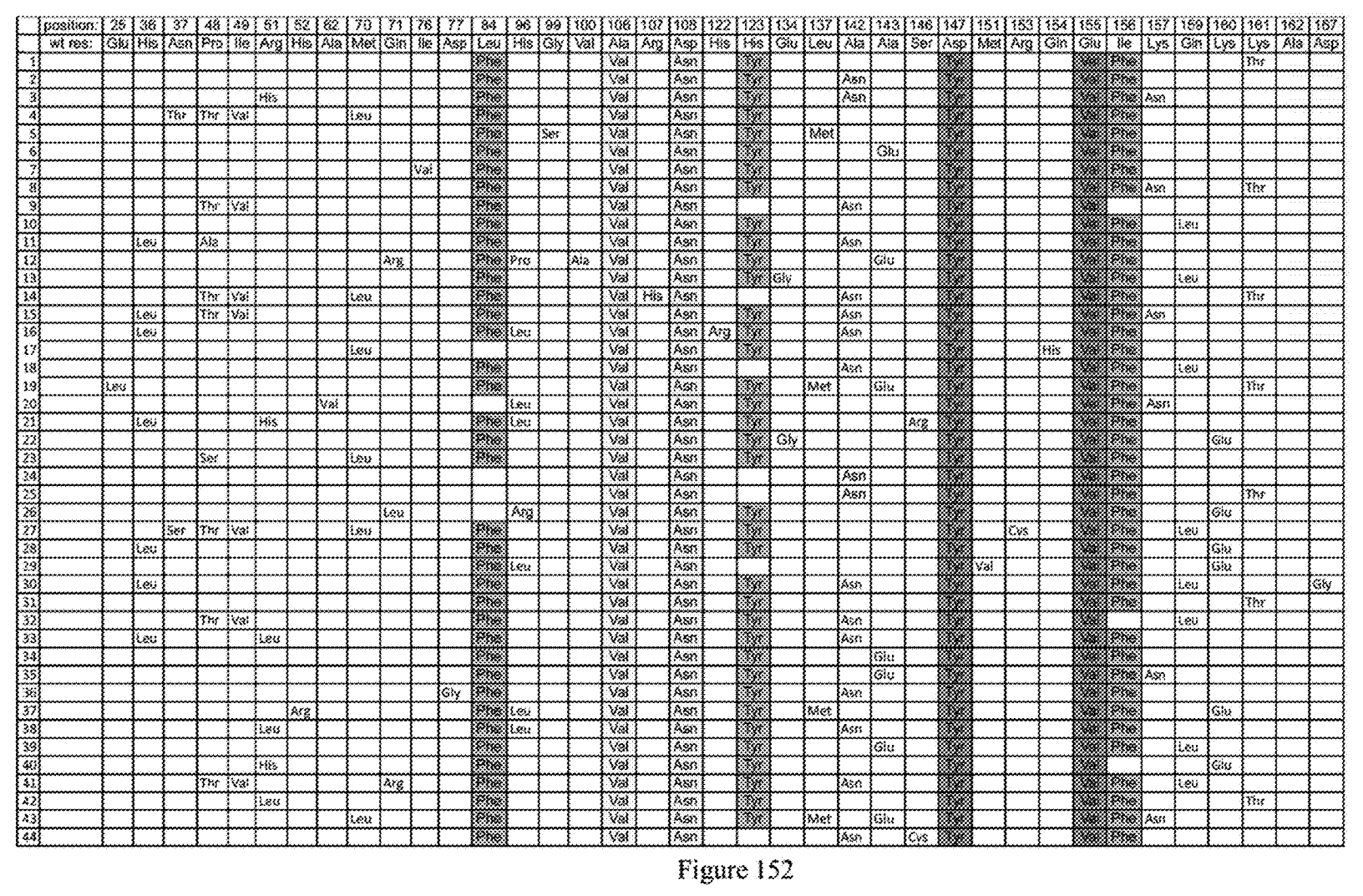

FIG. 152 shows the sequence identity of clones from evolution #6 surviving on spect only (non-YAC target). The mutations indicated are relative to ecTadA (SEQ ID NO: 1).

Figure 153:
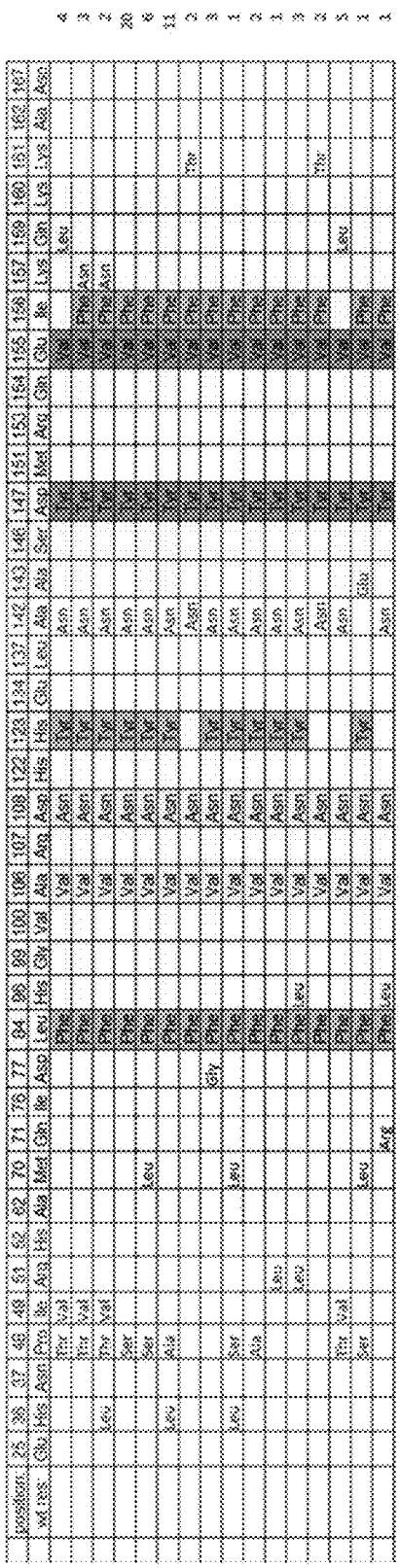

FIG. 153 shows evolution #6.2 which refers to the enrichment of clones from evolution #6. The mutations indicated are relative to ecTadA (SEQ ID NO: 1). A142N is present in almost all clones sequenced and the Pro48 mutation is also abundant. The clones were selected against "GAT" in the spectinomycin site. The selection target sequence was 5'-CAATGATGACTTCTACAGCG-3' (SEQ ID NO: 444).

Figure 154:
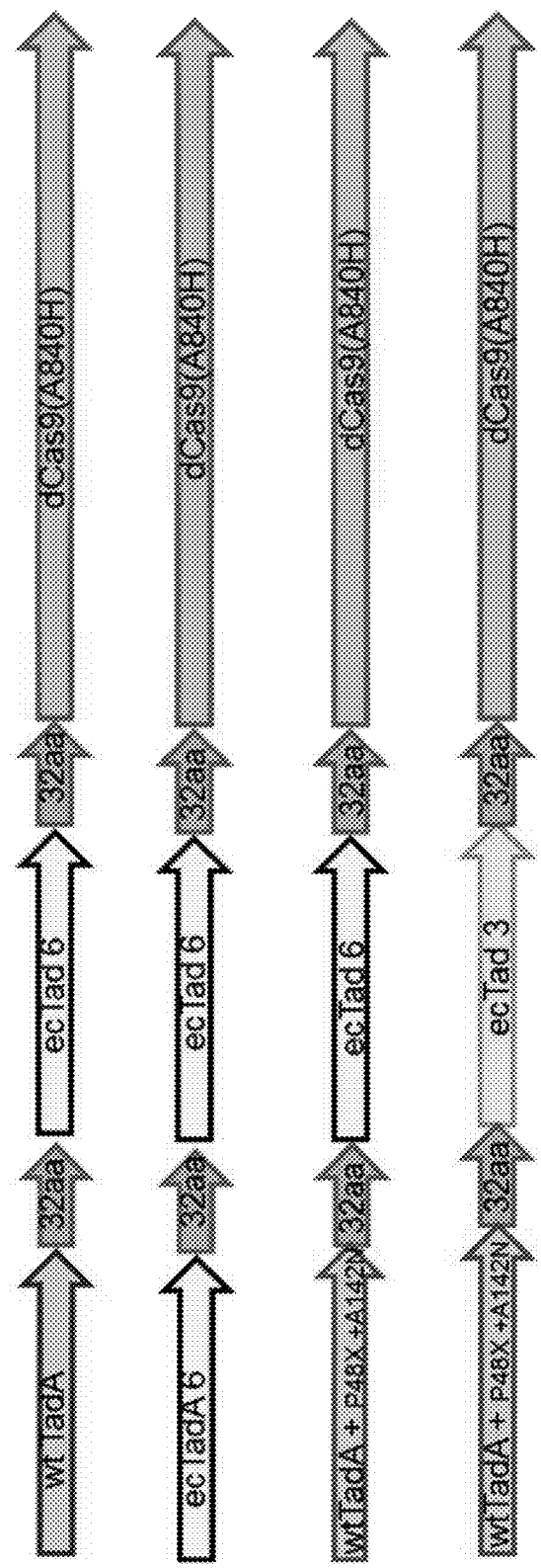

FIG. 154 shows schematic representations of ABE 6 constructs. 8 new constructs in total were developed. Mutations from the top 2 highest frequency amplicons in Evo #6 were used in each of the four architectures.

FIG. 155 shows data harvesting for ABE: step 1-transfection+HTS of key intermediates at 6 genomic sites, n=3. The transfection was performed with 750 ng ABE+250 ng gRNA and incubated for 5 days before the genomic DNA was extracted to perform HTS. The identity of each of the ABE constructs is indicated by the pNMG reference number as shown in Table 4. The sequences correspond to SEQ ID NOs: 509, 510, 512, 520, 530, 478 from top to bottom, respectively.

Figure 156:
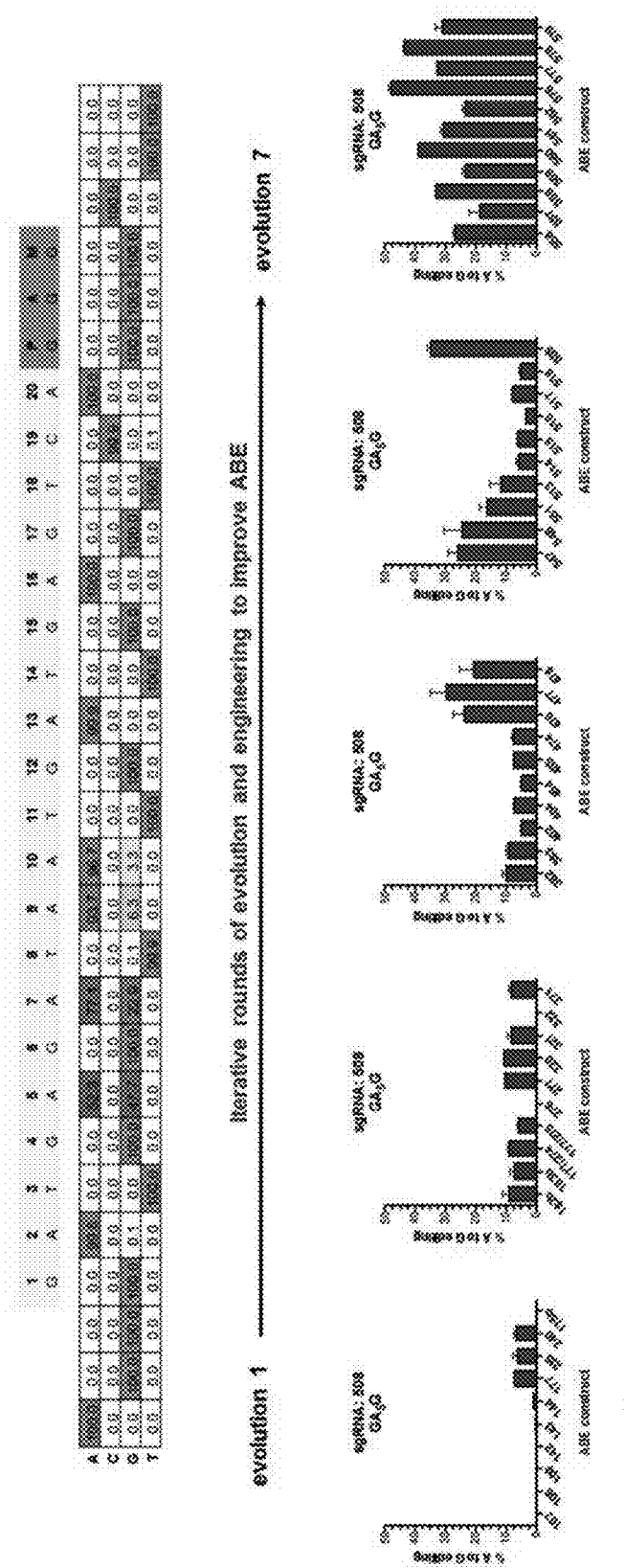

FIG. 156 shows that ABE editing efficiencies improve with iterative rounds of evolution. The top panel shows representative A to G % editing at targeted genetic locus in Hek293T cells using evolved/engineered ABE construct. The sequence corresponds to SEQ ID NO: 561. The bottom panel shows that iterative rounds of evolution and engineering improve ABE. ABE constructs are indicated by their pNMG reference numbers as shown in Table 4. The '508' target sequence corresponds to SEQ ID NO: 520.

Figure 157:
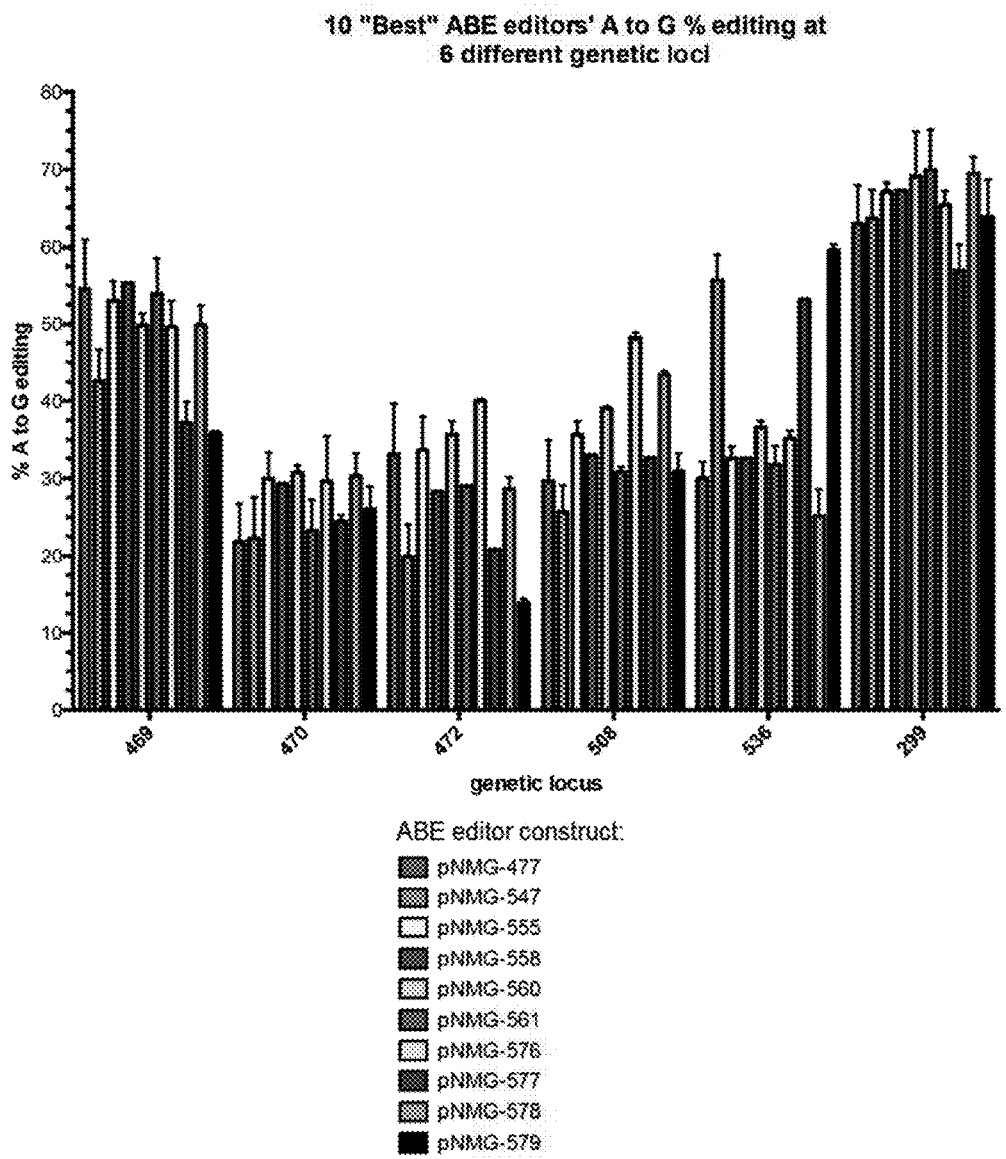

FIG. 157 shows HTS results of core 6 genomic sites from the 10 "Best" ABE. The results indicate that different editors have different local sequence preference (bottom panel). The graph shows the A to G percent editing at 6 different genetic loci. ABE constructs are indicated by their pNMG reference numbers as shown in Table 4. The sequences correspond to SEQ ID NOs: 509, 510, 512, 520, 530, 478 from top to bottom, respectively.

FIG. 158 shows transfection of functioning "top 10" ABEs at all genomic sites covering every combination of NAN sequence. The data represents n=1. The sequences correspond to SEQ ID NOs: 489, 490, 493, 497, 503, 504, 507, 508, 511, and 513 from top to bottom, respectively.

Figure 159:
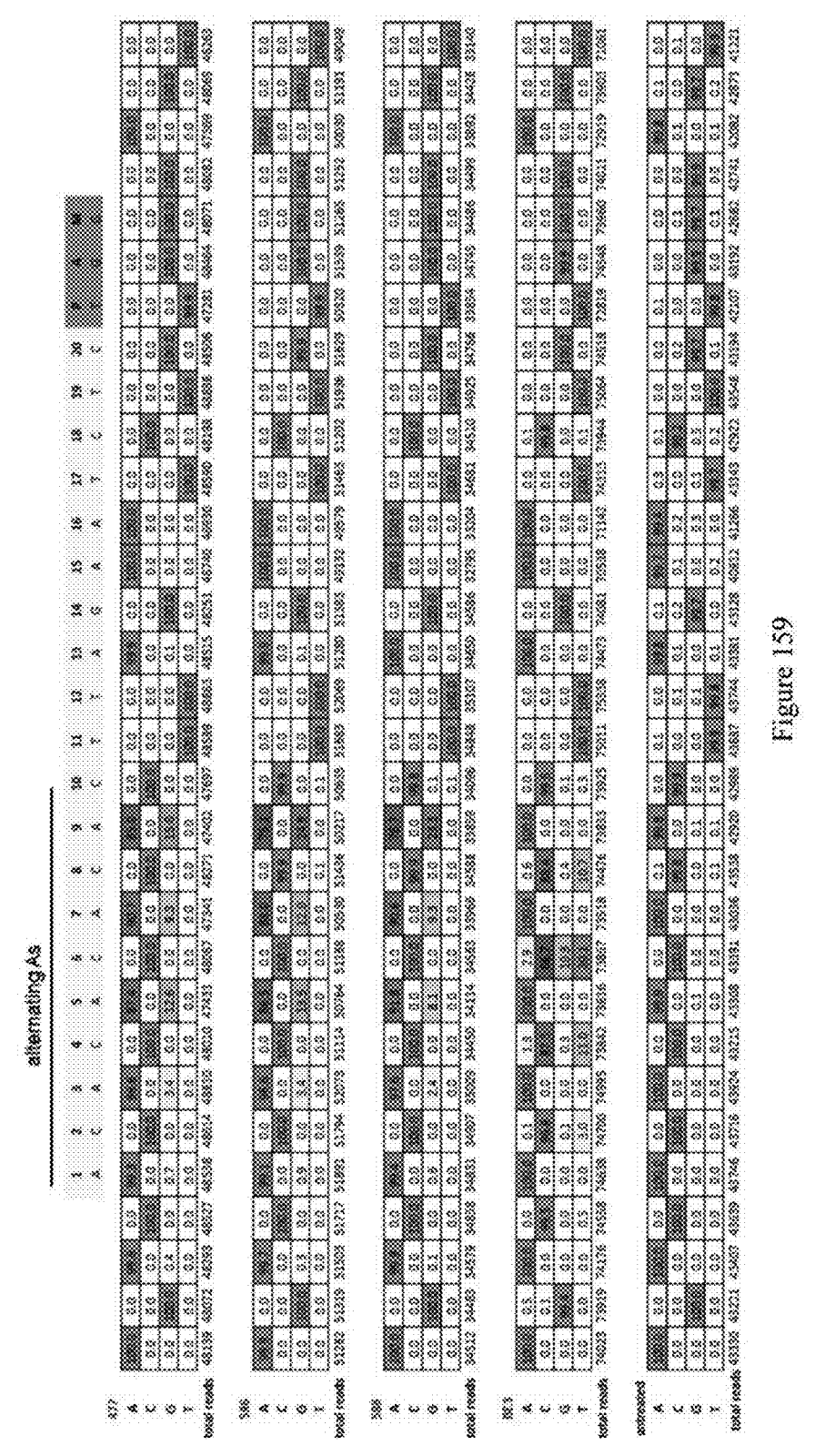

FIG. 159 shows ABE window experiments (A's at odd positions) for identifying which A's are edited. ABEs pNMG-477, pNMG-586, pNMG-588, BE3 and untreated control are shown. The sequence for editing is shown at the top. The sequence corresponds to SEQ ID NO: 562.

Figure 160:
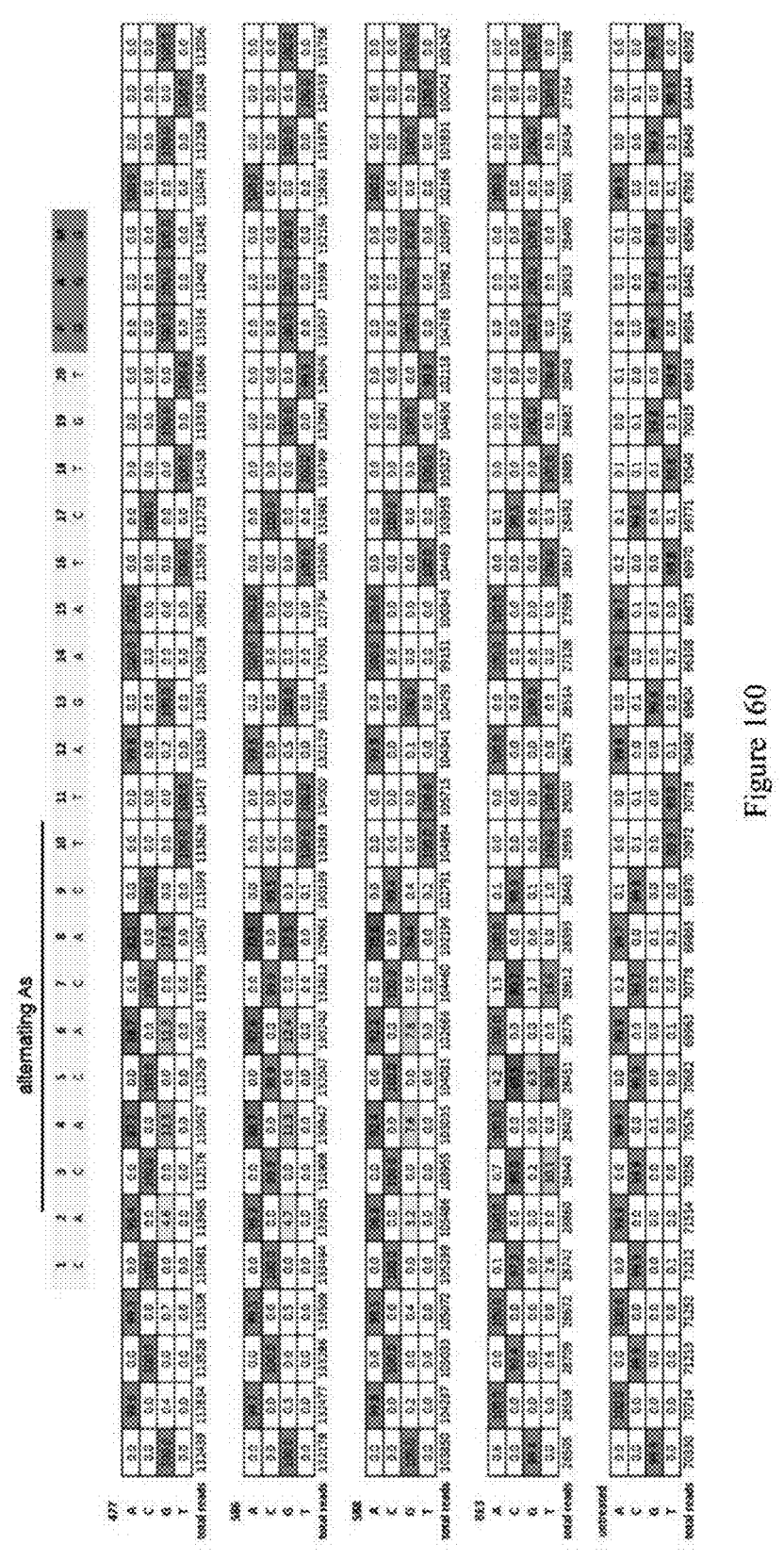

FIG. 160 shows ABE window experiment (A's at even positions) for identifying which A's are edited. ABEs pNMG-477, pNMG-586, pNMG-588, BE3 and untreated control are shown. The sequence for editing is shown at the top. The sequence corresponds to SEQ ID NO: 563.

Figure 161:
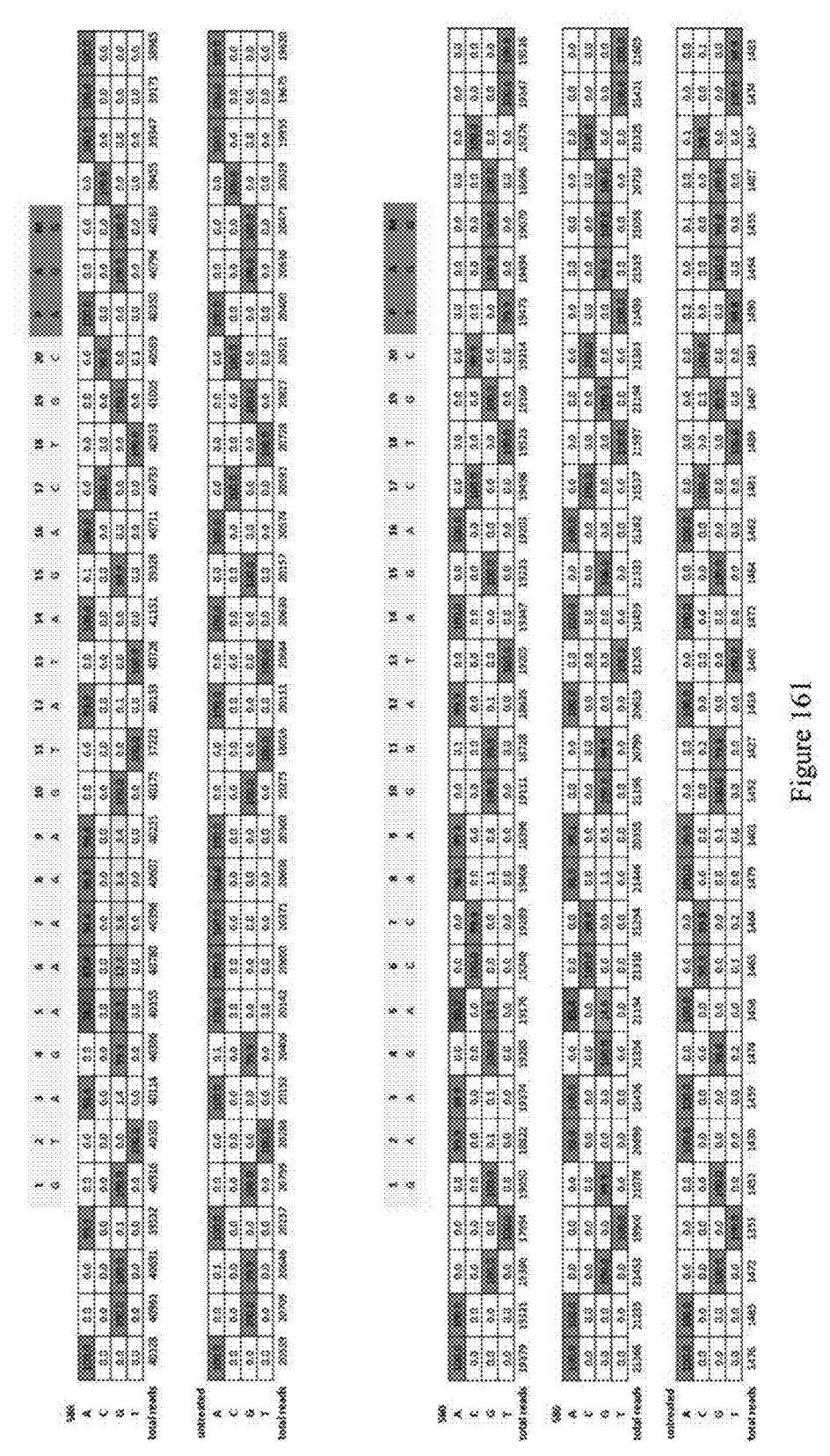

FIG. 161 shows additional ABE window experiments for identifying which A's are edited. ABEs pNMG-586, pNMG-560, and untreated control are shown. The sequence for editing is shown at the top. The sequences correspond to SEQ ID NOs: 544 and 541 from top to bottom, respectively.

Figure 162:
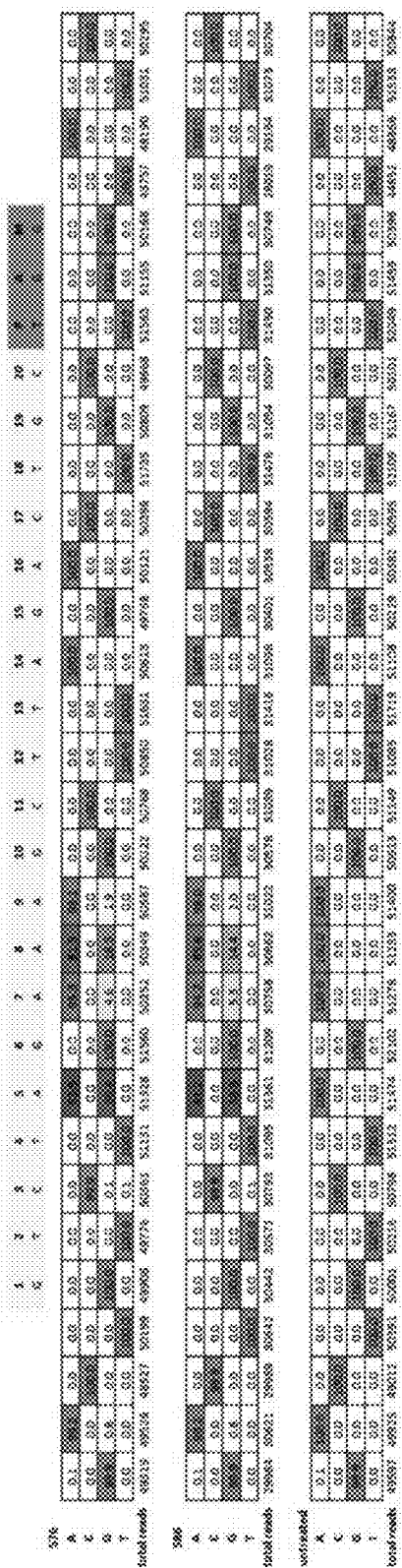

FIG. 162 shows additional ABE window experiments for identifying which A's are edited. ABEs pNMG-576, pNMG-586, and untreated control are shown. The sequence for editing is shown at the top. The sequence corresponds to SEQ ID NO: 564.

FIG. 163 shows evolution #7 an attempt to edit a multi-A site. The evolution selection design was to target 2 point mutations in the same gene using two separate gRNAs: 5'-TTCATTA(7)ACTGTGGCCGGCT-3'(SEQ ID NO: 565) and 5'-ATCTTA(6)TTCGATCATGCGAA-3' (SEQ ID NO: 566) in order to make a D208N reversion mutation in Kan and to revert a stop codon to a Q.

Figure 164:
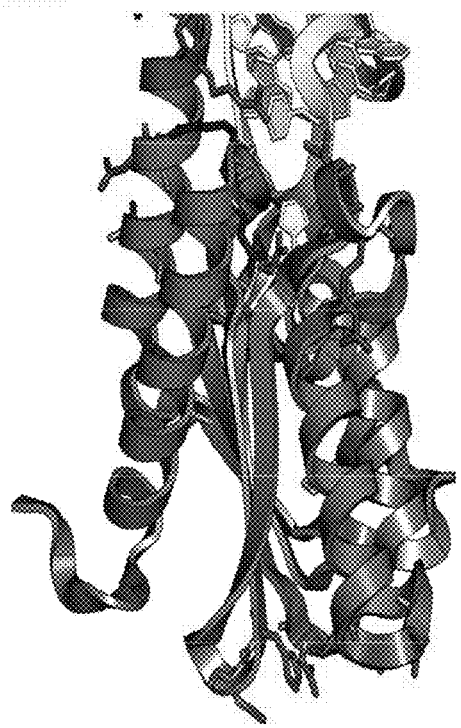

FIG. 164 shows evolution #7 mutations which were evolved to trget As within a multi A site, meaning that they are flanked on one or both sides by an A. The identity of mutations, relative to SEQ ID NO: 1 are shown.

FIG. 165 shows schematics of ecTadA identifying residues R152 and P48.

FIG. 166 shows MiSeq results of ABE editing on disease relevant mutations in alternative cell lines. Nucleofection with Lonza kit was used with 3 different nucleofection solutions×16 different electroporation conditions (48 total conditions/cell line). The sequences correspond to SEQ ID NOs: 522-524 from top to bottom, respectively.

Figure 167:
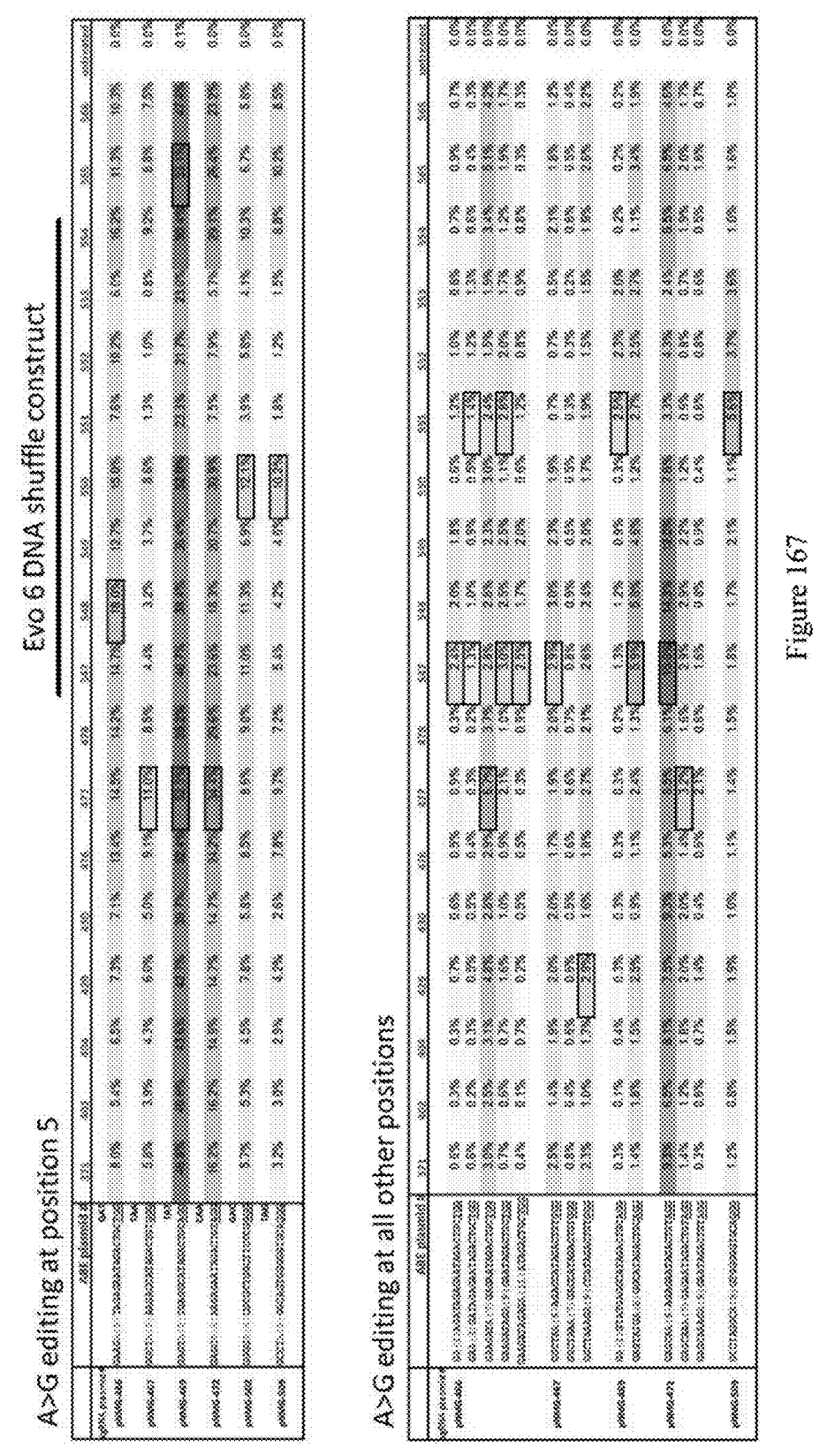

FIG. 167 shows results for A to G editing at multiple positions for various constructs. ABE constructs are indicated by their pNMG reference numbers as shown in Table 4. In the top panel the sequences correspond to SEQ ID NOs: 469-471, 567, 475, and 474 from top to bottom, respectively. In the bottom panel the sequences correspond to SEQ ID NOs: 469 (pNMG-466), 470 (pNMG-467), 471 (pNMG-469), 567 (pNMG-472), and 474 (pNMG-509) from top to bottom, respectively.

Figure 168:
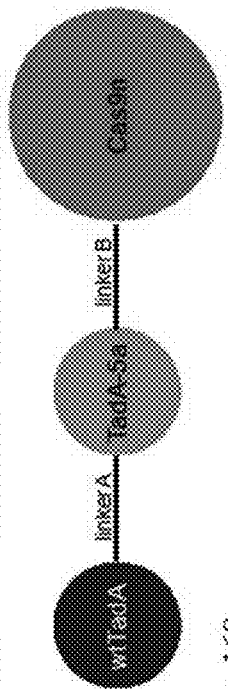

FIG. 168 shows editing results for various constructs using ABEs with different linkers. ABE constructs are indicated by their pNMG reference numbers as shown in Table 4. A schematic of the new linker ABE is also shown. The sequences correspond to SEQ ID NOs: 469 (pNMG-466), 568 (pNMG-468), 471 (pNMG-469), 567 (pNMG-472), 574 (pNGM-509), and 569) (pNMG-539) from top to bottom, respectively.

Figure 169:
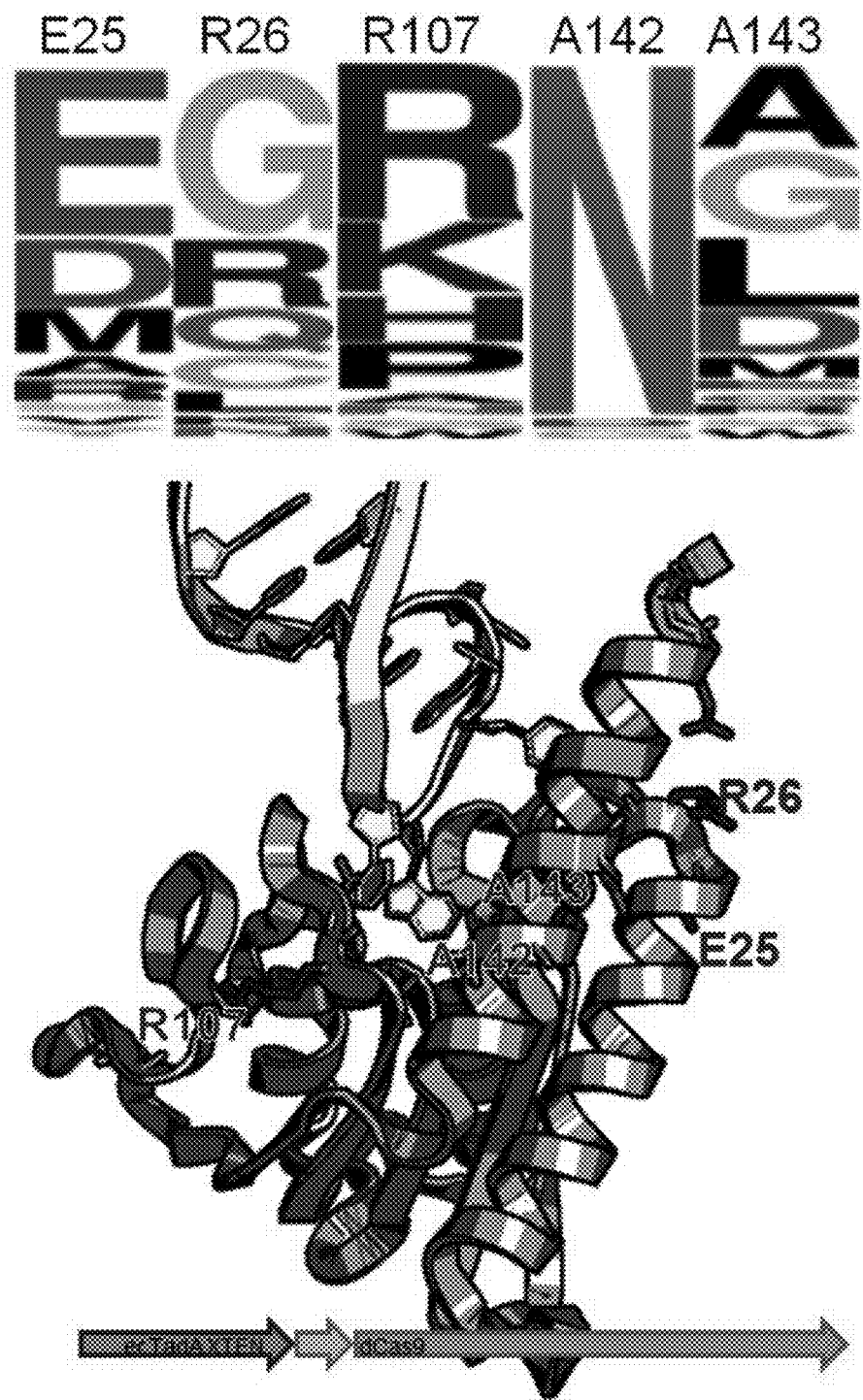

FIG. 169 shows the 4$^{th}$ round evolution. Evolution was done with a monomer construct and endogenous TadA complements TadA-dCas9 fusion.

Figure 170:
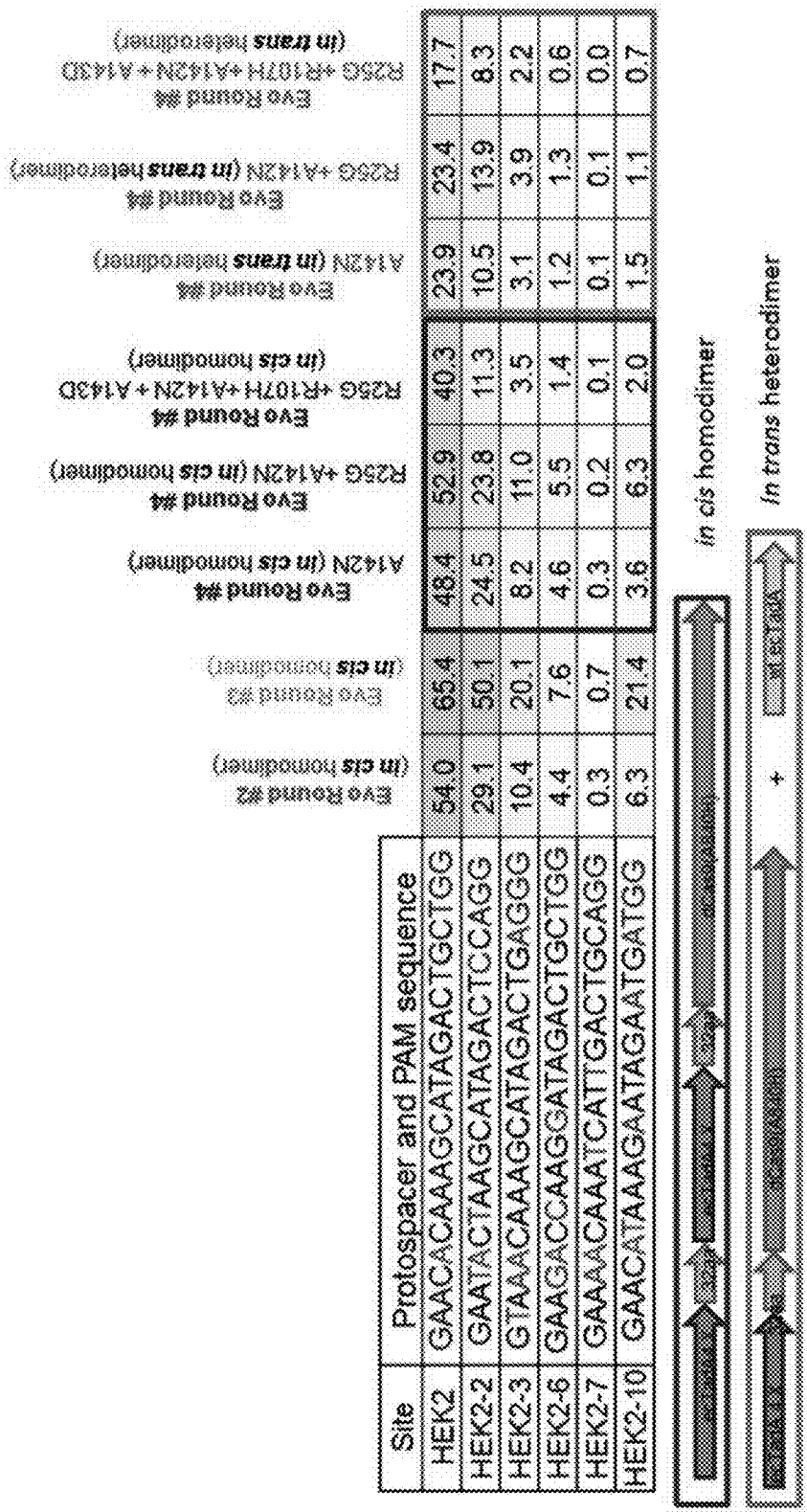

FIG. 170 shows 4$^{th}$ round evolution results. The sequences correspond to SEQ ID NOs: 7, 368, 363, 364, 369, and 370 from top to bottom, respectively.

Figure 171:
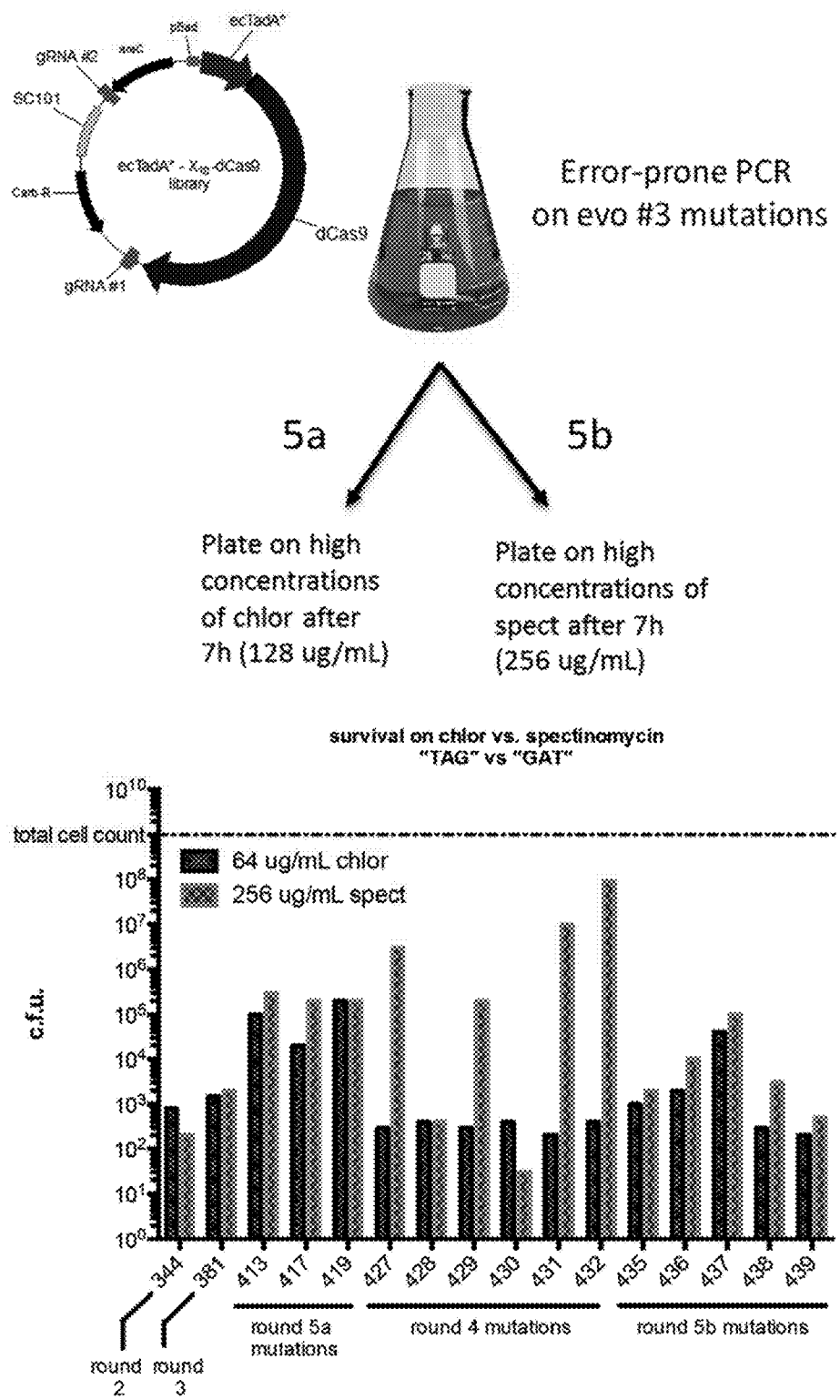

FIG. 171 shows evolution round #5. The plasmid and experimental outline are shown (top panel). The graph illustrates survival on chlor vs. spectinomycin "TAG" vs. "GAT." The chlor target sequence is 5'-TACGGCGT AGTGCACCTGGA-3' (SEQ ID NO: 441) and the spect target sequence is 5'-CAATG ATGACTTCTACAGCG-3'(SEQ ID NO: 444).

Figure 172:
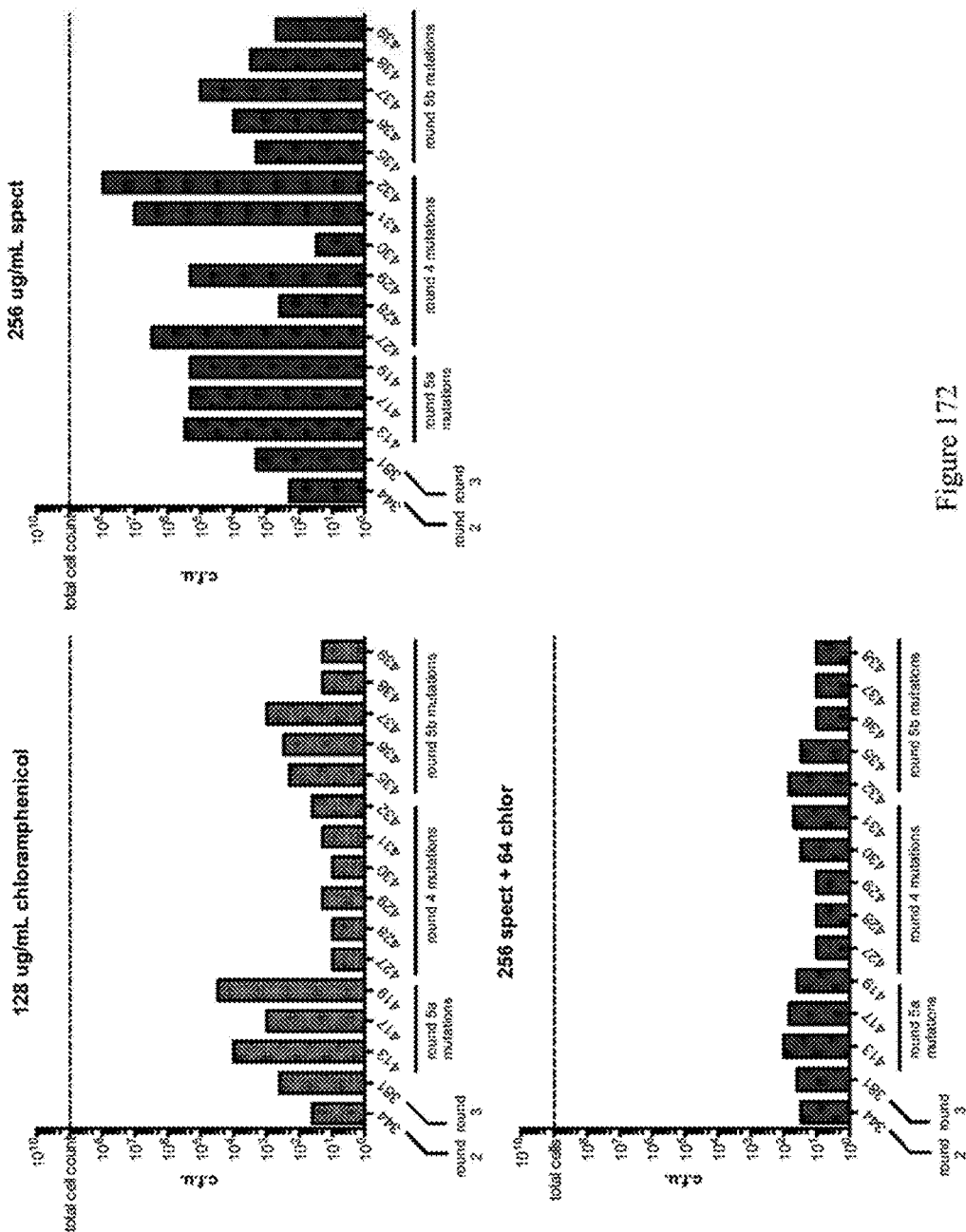

FIG. 172 shows editing results at the chlor and spect sites. Constructs identified from evolution #4 (site saturated/NNK library) appear edit more efficiently on the spect site rather than on the chor site. ABE constructs are indicated by their pNMG reference numbers as shown in Table 4.

Figure 173:
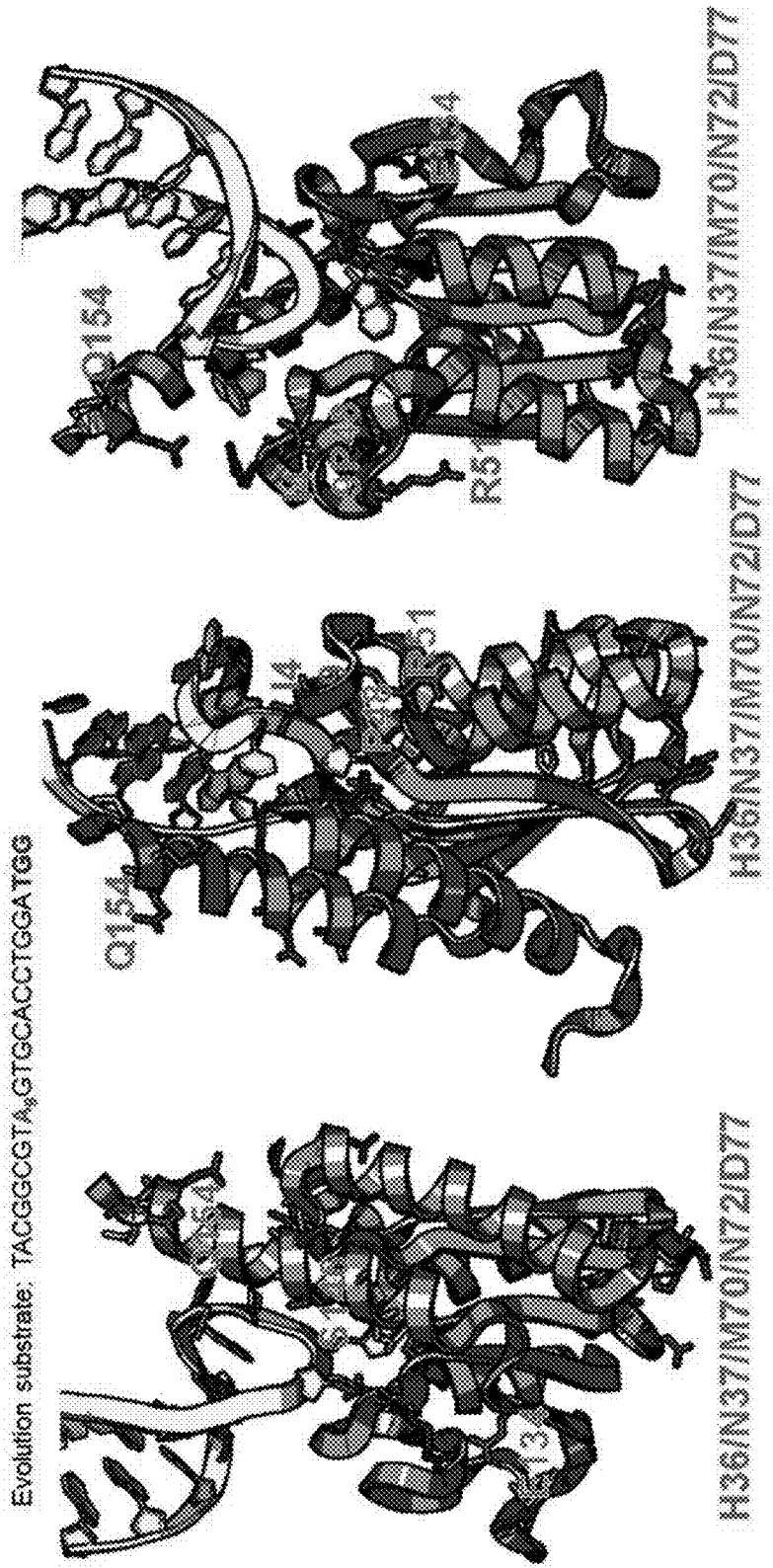

FIG. 173 shows 5$^{th}$ round evolution (part a). The sequence corresponds to SEQ ID NO: 570.

Figure 174:
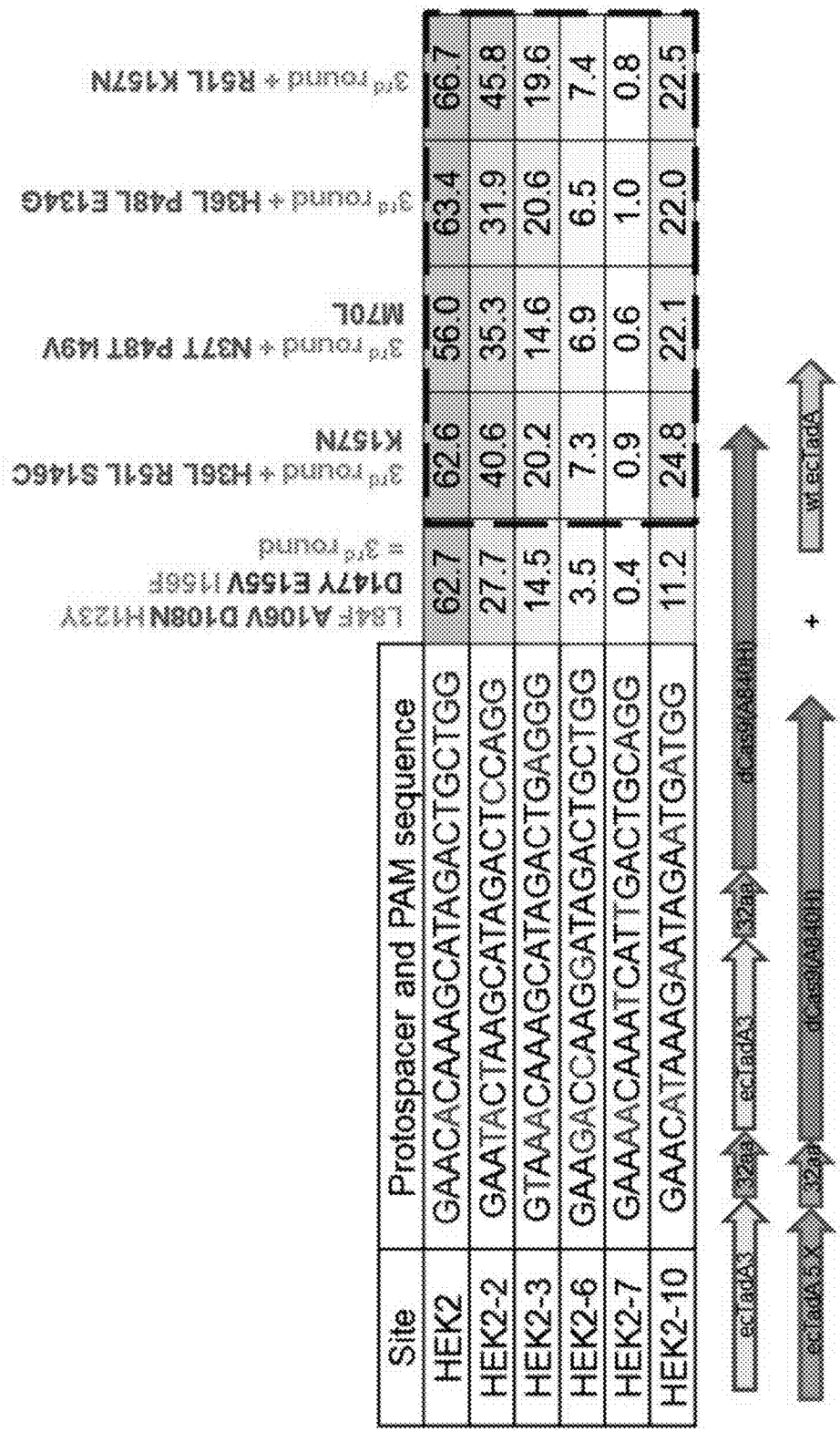

FIG. 174 shows 5$^{th}$ round heterodimer (in trans) results. Round #5a identified mutations improved both editing efficiencies and broadened substrate specificity. The sequences correspond to SEQ ID NOs: 7, 368, and 363, 364, 369, and 370 from top to bottom, respectively.

Figure 175:
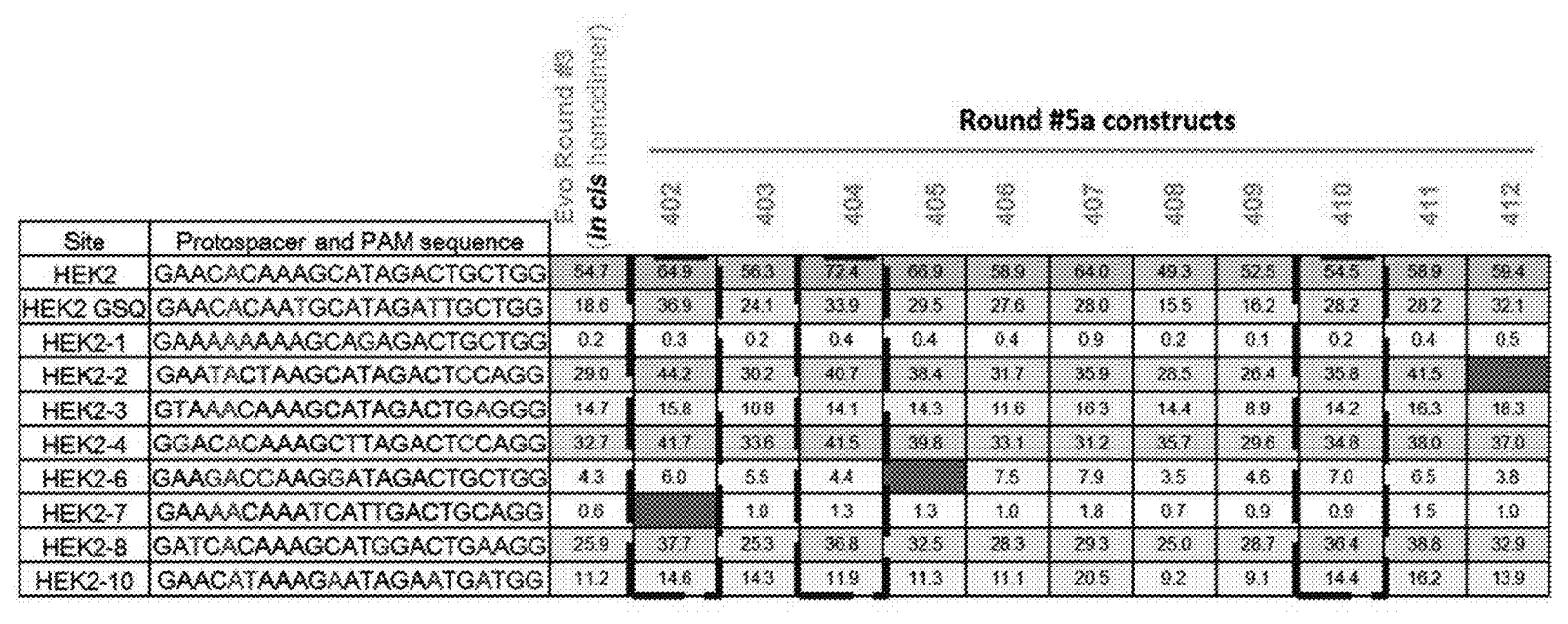

FIG. 175 shows 5$^{th}$ round heterodimer (in cis) results. Round #5a identified mutations improved both editing efficiencies and broadened substrate specificity, but the cis results gave higher editing efficiencies. ABE constructs are indicated by their pNMG reference numbers as shown in Table 4. The sequences correspond to SEQ ID NOs: 7, 571, 465, 368, 363, 466, 364, 369, 572, and 370 from top to bottom, respectively.

Figure 176:
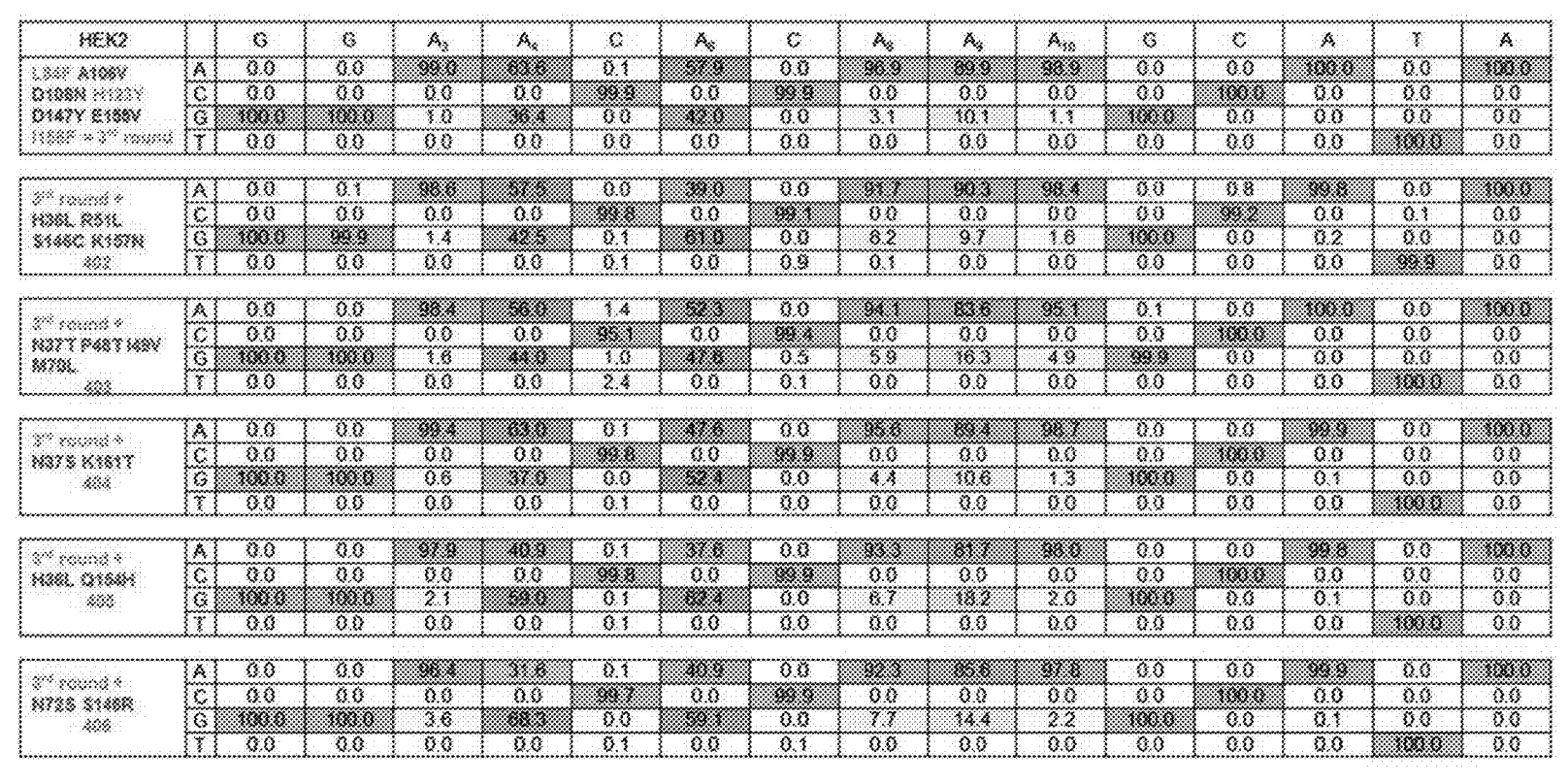

FIG. 176 shows editing results of various constructs for evolution 5.

Figure 177:
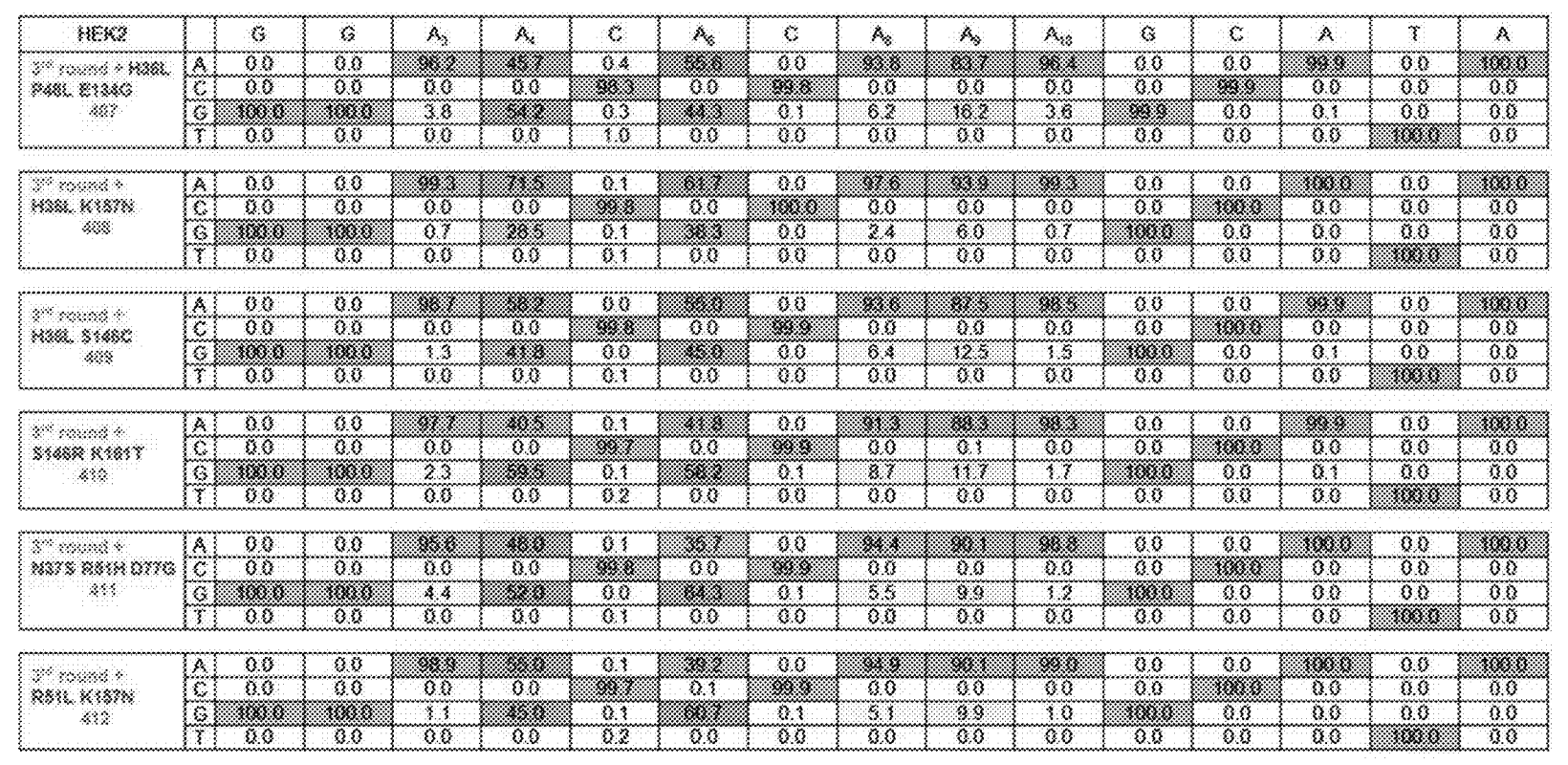

FIG. 177 shows editing results of various constructs for evolution 5.

FIG. 178 shows gRNAs for ABE. 5a constructs are characterized on all 16 NAN sequences A at position 5 in protospacer (left panel). The sequences correspond to SEQ ID NOs: 573-578 from top to bottom, respectively. Additional sequences starting with a "G" in order to minimize variations in yield gRNA synthesis are proposed (right panel). The sequences correspond to SEQ ID NOs: 579-588 from top to bottom, respectively.

Figure 179:
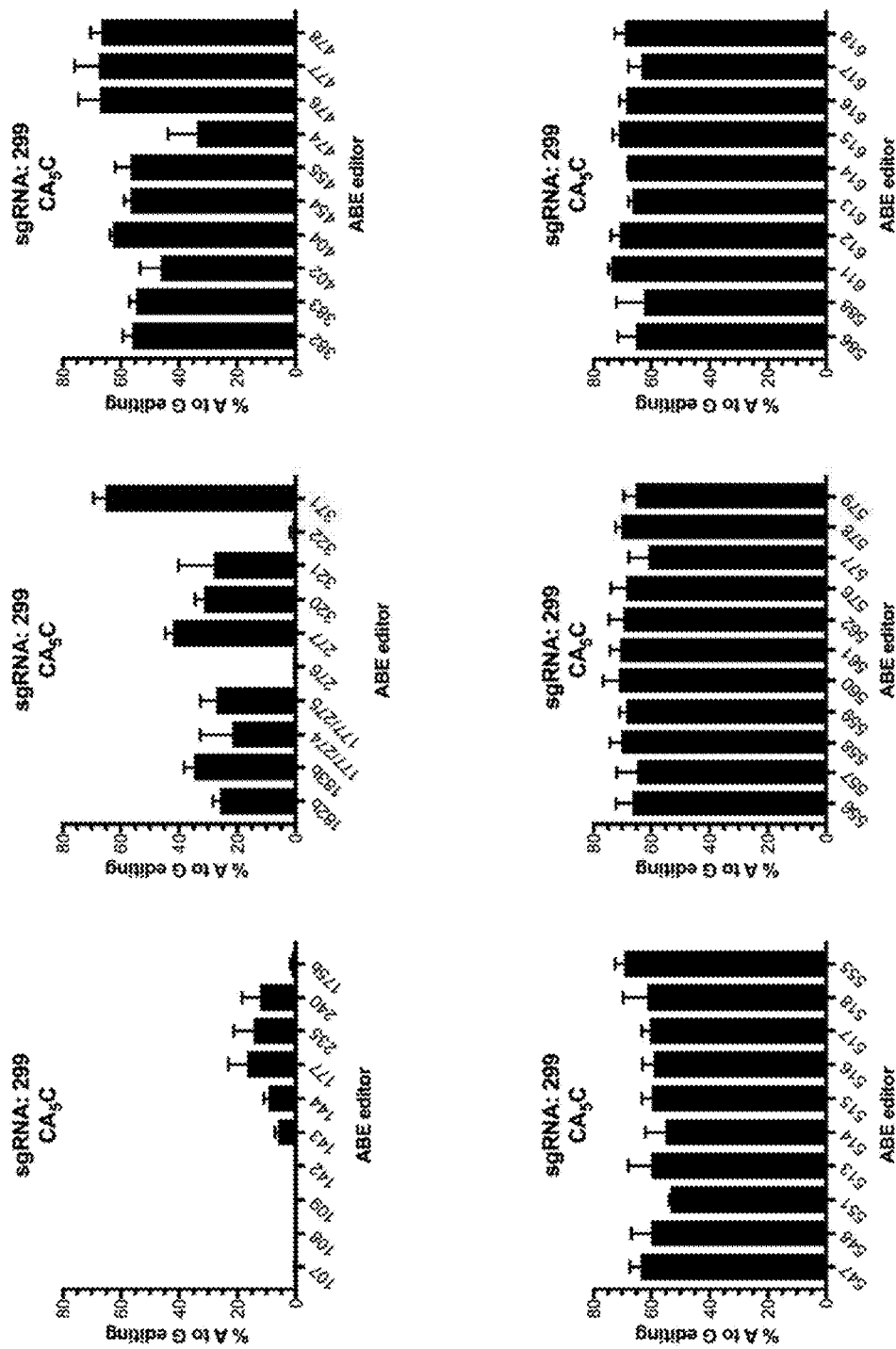

FIG. 179 shows % A to G editing of $A_5$ using sgRNA 299 as indicated in Table 8 and the ABE constructs, which are indicated by their pNMG reference numbers as shown in Table 4. The sequence corresponds to SEQ ID NO: 478.

Figure 180:
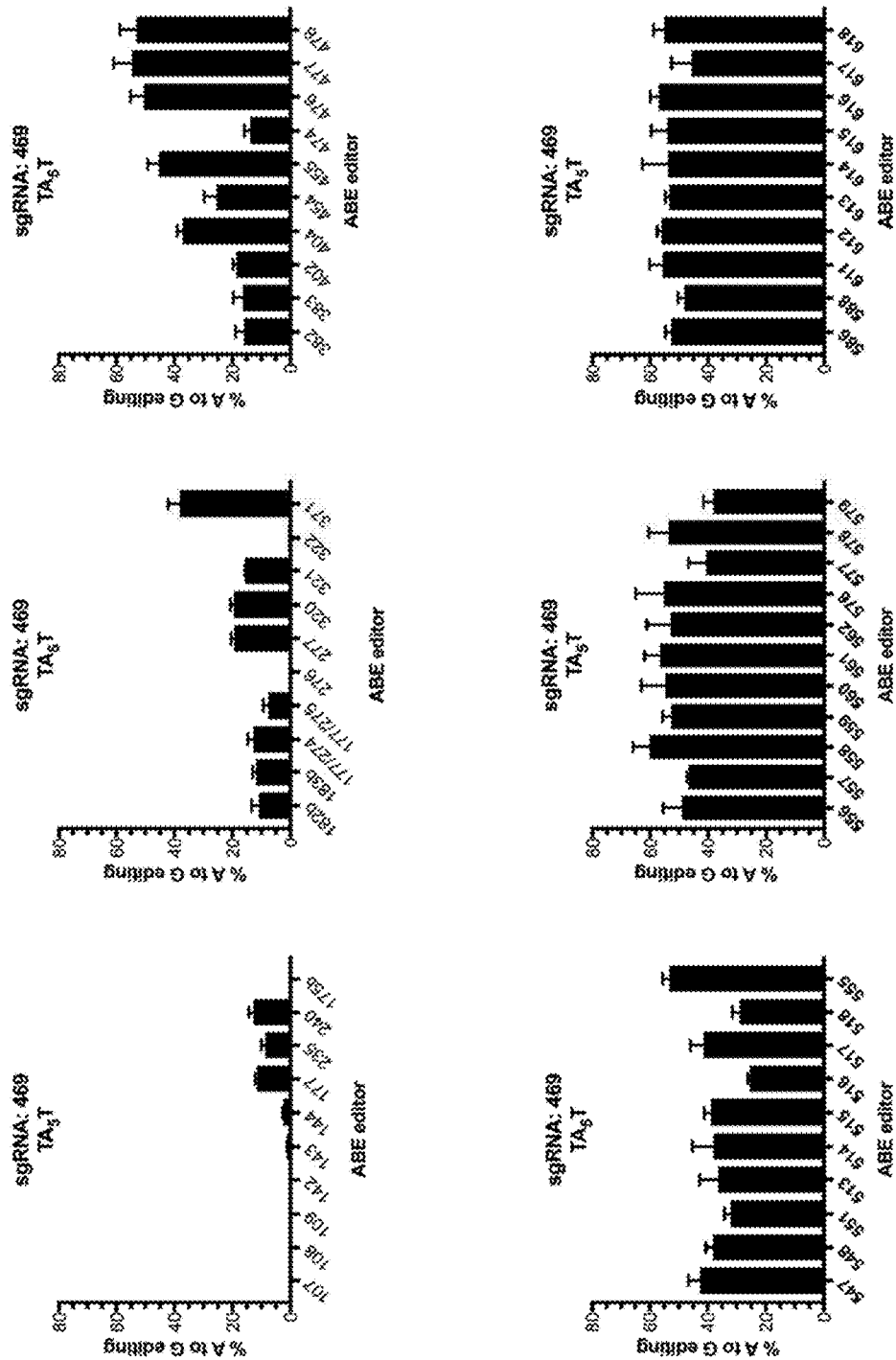

FIG. 180 shows % A to G editing of $A_5$ using sgRNA 469 as indicated in Table 8 and the ABE constructs, which are indicated by their pNMG reference numbers as shown in Table 4. The sequence corresponds to SEQ ID NO: 509.

Figure 181:
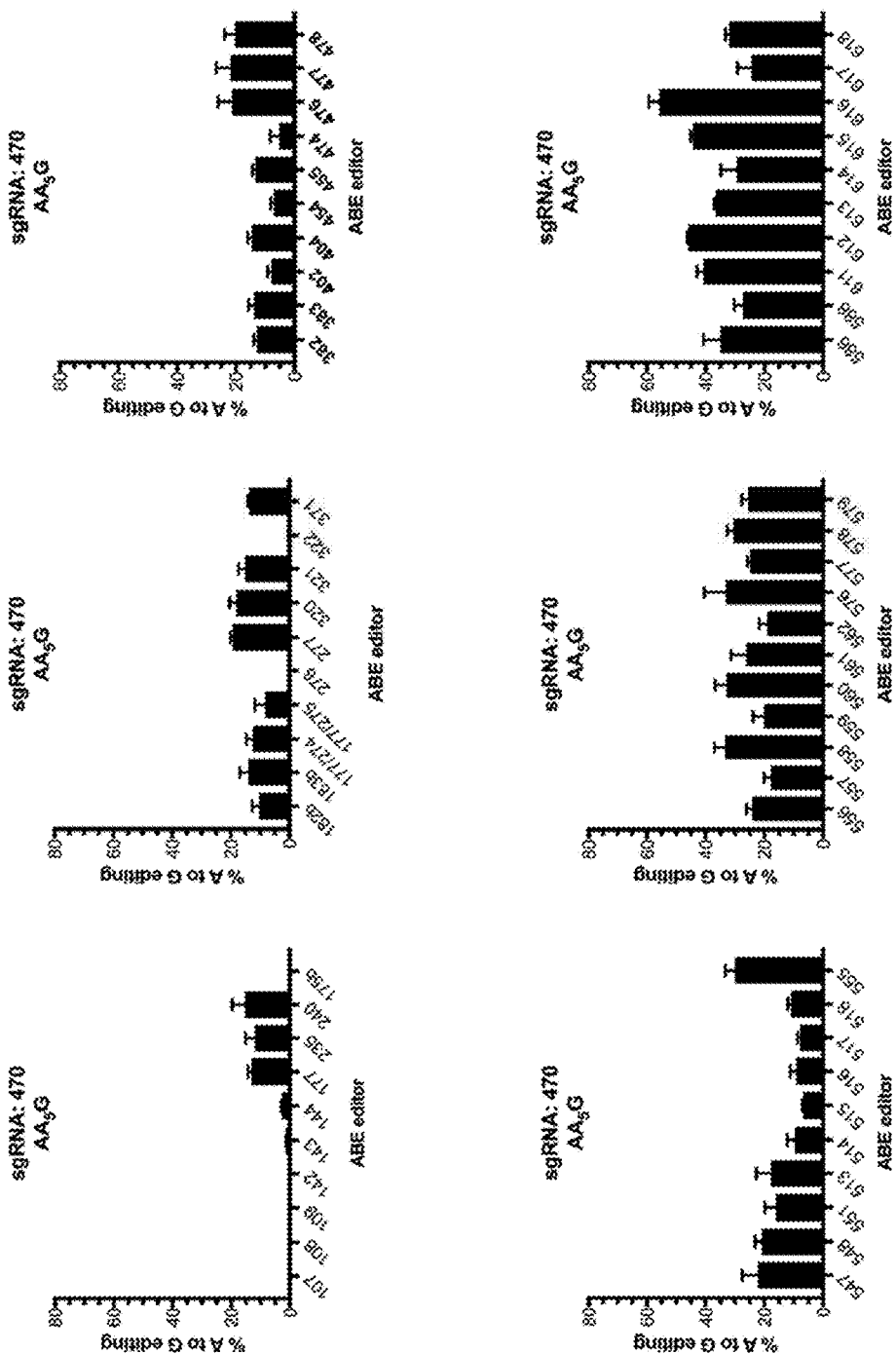

FIG. 181 shows % A to G editing of $A_5$ using sgRNA 470 as indicated in Table 8 and the ABE constructs, which are indicated by their pNMG reference numbers as shown in Table 4. The sequence corresponds to SEQ ID NO: 510.

Figure 182:
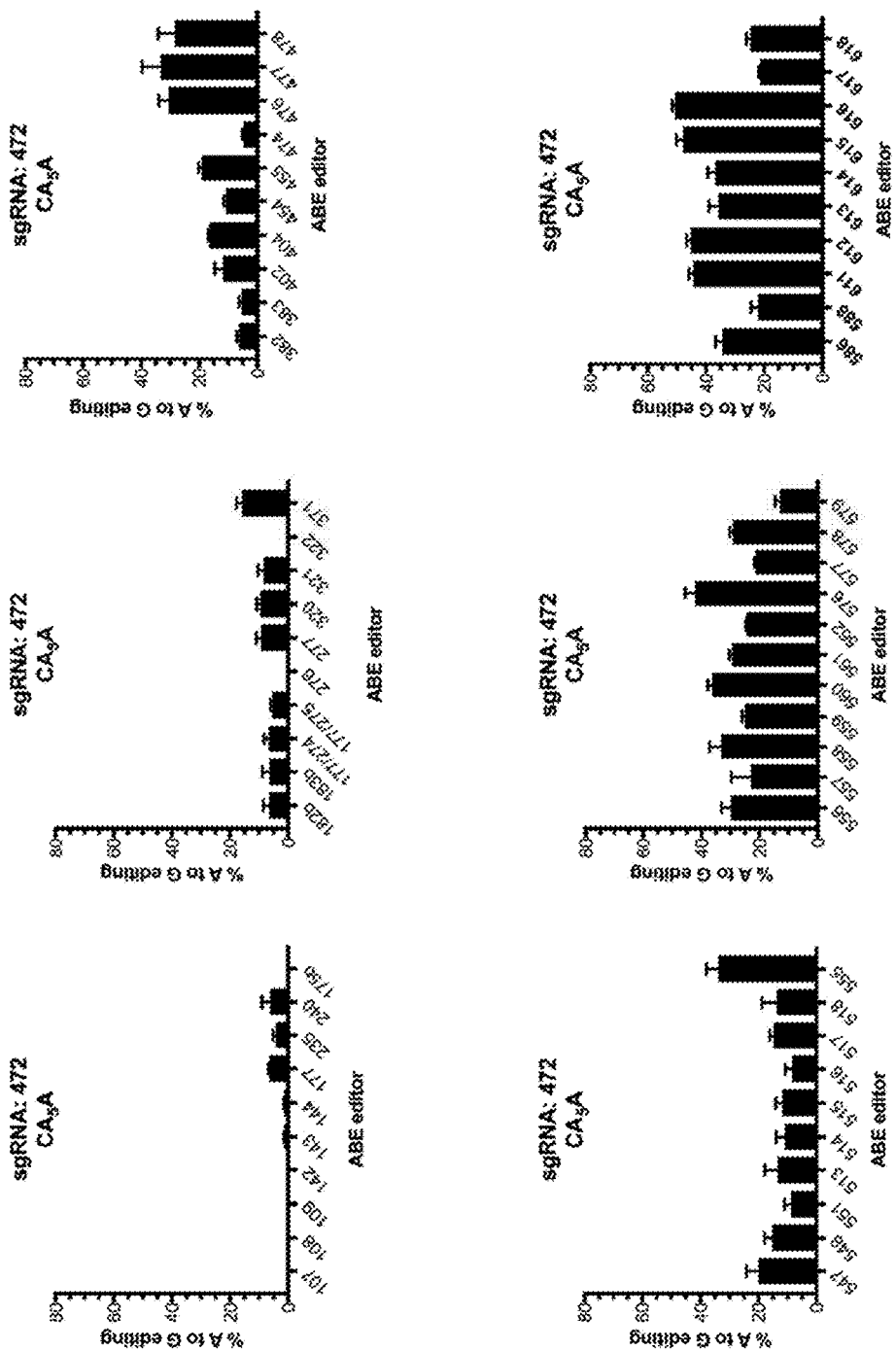

FIG. 182 shows % A to G editing of $A_5$ using sgRNA 472 as indicated in Table 8 and the ABE constructs, which are indicated by their pNMG reference numbers as shown in Table 4. The sequence corresponds to SEQ ID NO: 512.

Figure 183:
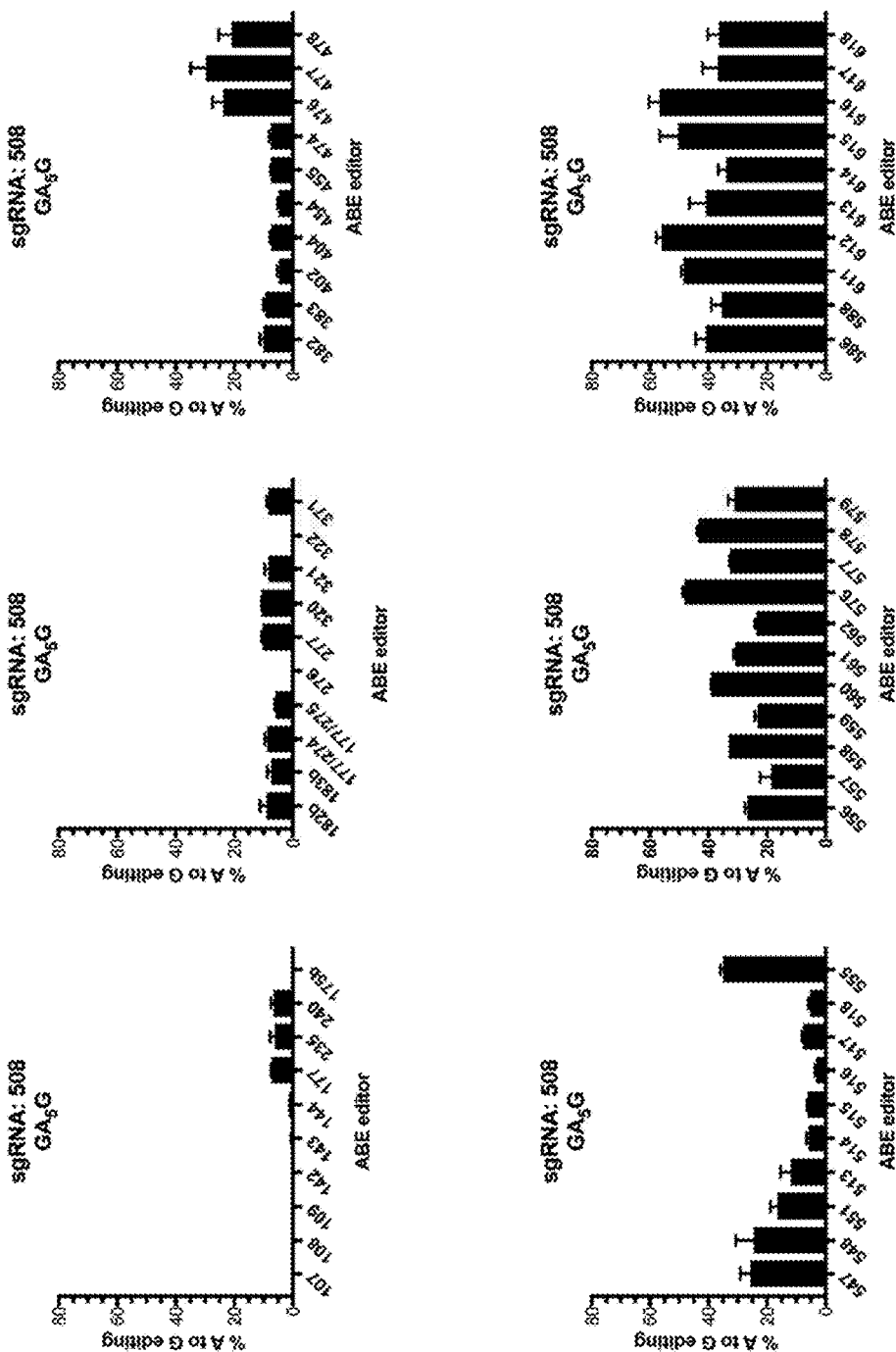

FIG. 183 shows % A to G editing of $A_5$ using sgRNA 508 as indicated in Table 8 and the ABE constructs, which are indicated by their pNMG reference numbers as shown in Table 4. The sequence corresponds to SEQ ID NO: 520.

Figure 184:
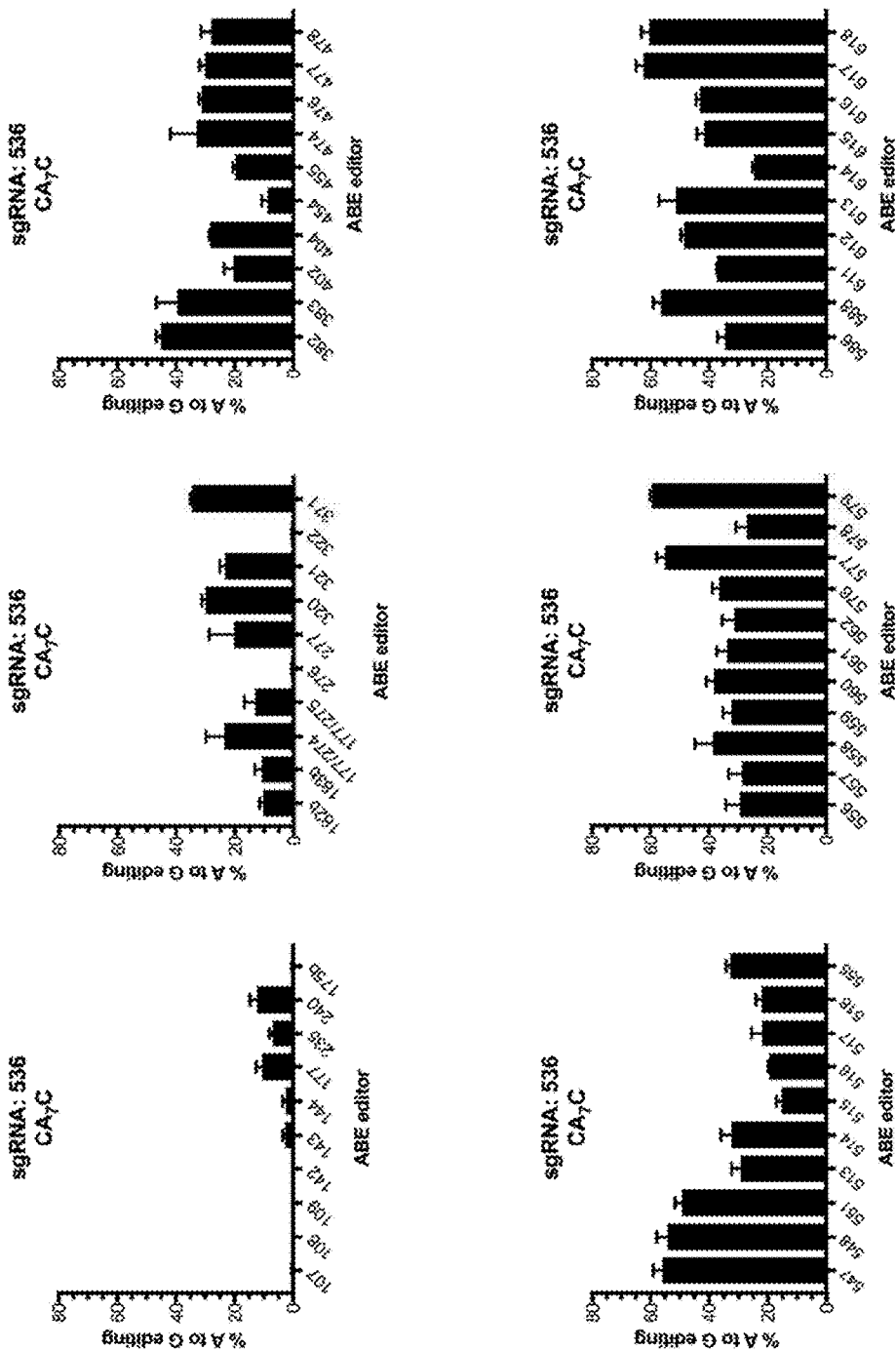

FIG. 184 shows % A to G editing of $A_7$ using sgRNA 536 as indicated in Table 8 and the ABE constructs, which are indicated by their pNMG reference numbers as shown in Table 4. The sequence corresponds to SEQ ID NO: 530.

Figure 185:
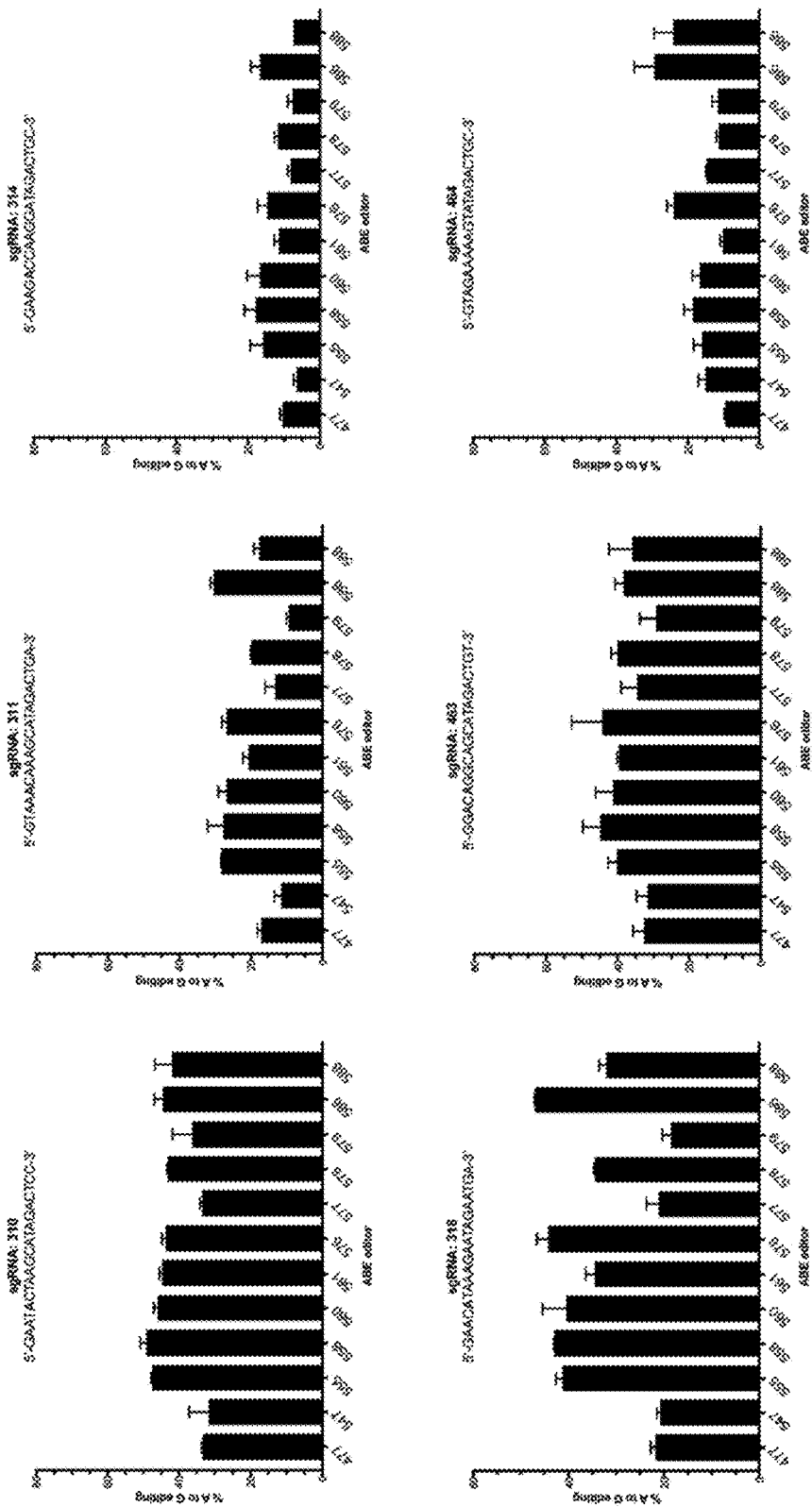

FIG. 185 shows the % of A to G editing of the highlighted A ($A_5$) using sgRNA: 310, sgRNA: 311, sgRNA: 314, sgRNA: 318, sgRNA: 463, and sgRNA: 464 for each of the indicated base editors, which are indicated by their pNMG reference numbers as shown in Table 4. The sequences correspond to SEQ ID NOs: 489, 490, 493, 497, 503 and 504 from left to right and top to bottom, respectively.

Figure 186:
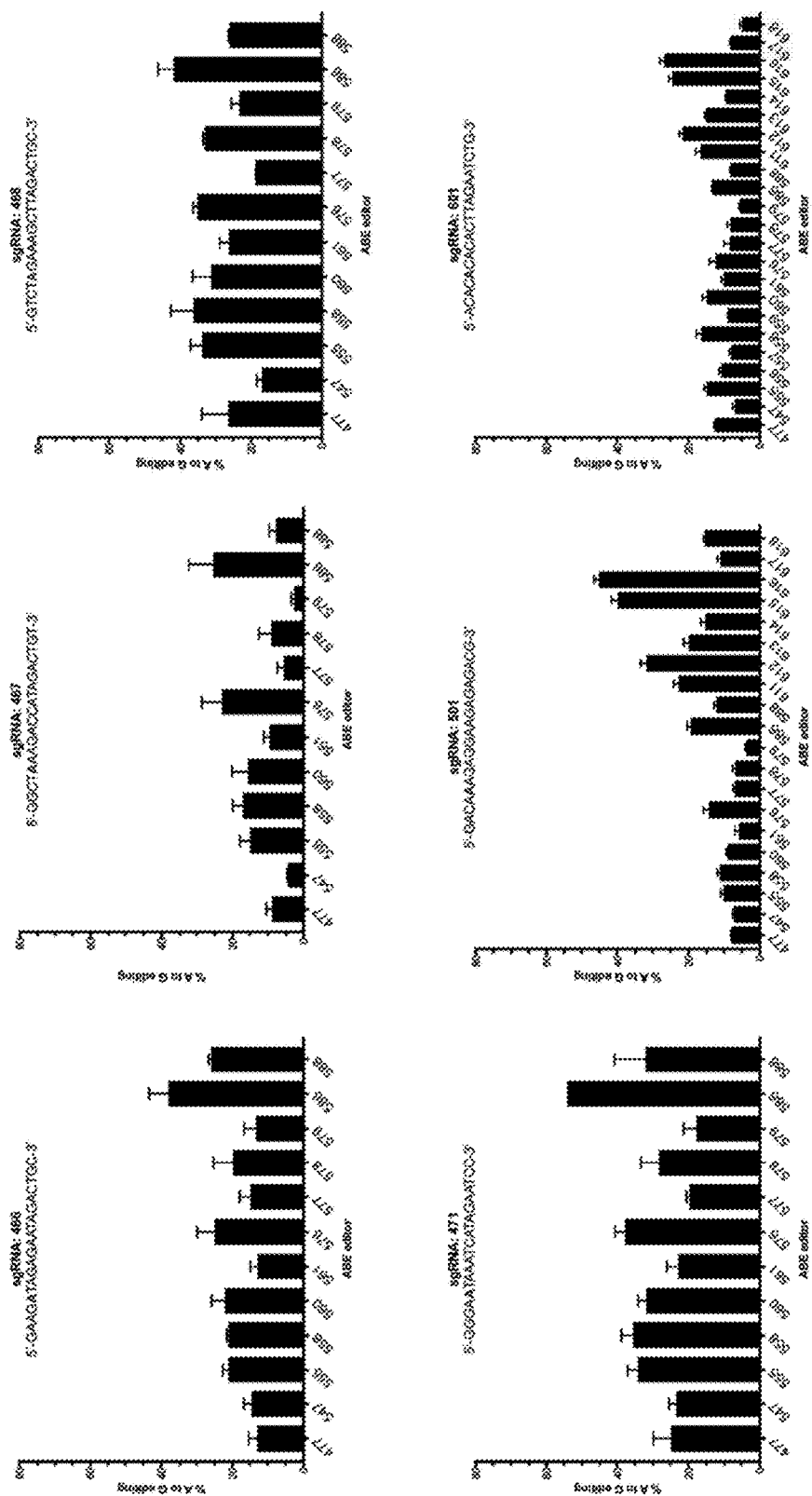

FIG. 186 shows the % of A to G editing of the highlighted A ($A_5$) using sgRNA: 466, sgRNA: 467, sgRNA: 468, sgRNA: 471, sgRNA: 501, and sgRNA: 601 for each of the indicated base editors, which are indicated by their pNMG reference numbers as shown in Table 4. The sequences correspond to SEQ ID NOs: 506, 507, 508, 511, 513, and 535 from left to right and top to bottom, respectively.

DEFINITIONS

As used herein and in the claims, the singular forms "a," "an," and "the" include the singular and the plural unless the context clearly indicates otherwise. Thus, for example, a reference to "an agent" includes a single agent and a plurality of such agents.

The term "deaminase" or "deaminase domain" refers to a protein or enzyme that catalyzes a deamination reaction. In some embodiments, the deaminase is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA deaminase (ecTadA). In some embodiments, the TadA deaminase is a truncated E. coli TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine In some embodiments, the TadA deaminase is an N-terminal truncated TadA. In certain embodiments, the adenosine deaminase comprises the amino acid sequence:

(SEQ ID NO: 1)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD.

In some embodiments the TadA deaminase is a full-length E. coli TadA deaminase. For example, in certain embodiments, the adenosine deaminase comprises the amino acid sequence:

(SEQ ID NO: 84)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

Staphylococcus aureus TadA:
(SEQ ID NO: 8)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

```
                                                     -continued
RVVYGADDPKGGCSGSLMNLLQQSNFNHRAIVDKGVLKEACSTLLTTFFK

NLRANKKSTN

Bacillus subtilis TadA:
                                                    (SEQ ID NO: 9)
MTQDELYMKEAIKEAKKAEEKGEVPIGAVLVINGEIIARAHNLRETEQRS

IAHAEMLVID

EACKALGTWRLEGATLYVTLEPCPMCAGAVVLSRVEKVVFGAFDPKGGCS

GTLMNLLQEERFNHQAEVVSGVLEEECGGMLSAFFRELRKKKKAARKNLS

E

Salmonella typhimurium (S. typhimurium) TadA:
                                                    (SEQ ID NO: 371)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAGPAV

Shewanella putrefaciens (S. putrefaciens) TadA:
                                                    (SEQ ID NO: 372)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

Haemophilus influenzae F3031 (H. influenzae) TadA:
                                                    (SEQ ID NO: 373)
MDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

Caulobacter crescentus (C. crescentus) TadA:
                                                    (SEQ ID NO: 374)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

Geobacter sulfurreducens (G. sulfurreducens) TadA:
                                                    (SEQ ID NO: 375)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP
```

The term "base editor (BE)," or "nucleobase editor (NBE)" refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA. In some embodiments, the base editor is a fusion protein comprising a nucleic acid programmable DNA binding protein (napDNAbp) fused to an adenosine deaminase. In some embodiments, the base editor is a Cas9 protein fused to an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In some embodiments, the dCas9 domain of the fusion protein comprises a D10A and a H840A mutation of SEQ ID NO: 52, or a corresponding mutation in any of SEQ ID NOs: 108-357, which inactivates the nuclease activity of the Cas9 protein. In some embodiments, the fusion protein comprises a D10A mutation and comprises a histidine at residue 840 of SEQ ID NO: 52, or a corresponding mutation in any of SEQ ID NOs: 108-357, which renders Cas9 capable of cleaving only one strand of a nucleic acid duplex. An example of a Cas9 nickase is shown in SEQ ID NO: 35.

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises (SGGS)$_n$ (SEQ ID NO: 37), (GGGS)$_n$ (SEQ ID NO: 38), (GGGGS)$_n$ (SEQ ID NO: 39), (G)$_n$, (EAAAK)$_n$ (SEQ ID NO: 40), (GGS)$_n$, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3, or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence:

```
>sp|P14739|UNGI_BPPB2 Uracil-DNA glycosylase
inhibitor
                                    (SEQ ID NO: 3)
MTNLSDIIEKETGKQLVIQESILMLPEEVEEVIGNKPESDILVHTAYDES

TDENVMLLTSDAPEYKPWALVIQDSNGENKIKML.
```

The term "catalytically inactive inosine-specific nuclease," or "dead inosine-specific nuclease (dISN)," as used herein, refers to a protein that is capable of inhibiting an inosine-specific nuclease. Without wishing to be bound by any particular theory, catalytically inactive inosine glycosylases (e.g., alkyl adenine glycosylase [AAG]) will bind inosine, but will not create an abasic site or remove the inosine, thereby sterically blocking the newly-formed inosine moiety from DNA damage/repair mechanisms. In some embodiments, the catalytically inactive inosine-specific nuclease may be capable of binding an inosine in a nucleic acid but does not cleave the nucleic acid. Exemplary catalytically inactive inosine-specific nucleases include, without limitation, catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation as shown in SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as shown in SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure. Truncated AAG (*H. sapiens*) nuclease (E125Q); mutated residue underlined in bold.

```
                                    (SEQ ID NO: 32)
KGHLTRLGLEFFDQPAVPLARAFLGQVLVRRLPNGTELRGRIVETQAYLG

PEDEAAHSRGGRQTPRNRGMFMKPGTLYVYIIYGMYFCMNISSQGDGACV

LLRALEPLEGLETMRQLRSTLRKGTASRVLKDRELCSGPSKLCQALAINK

SFDQRDLAQDEAVWLERGPLEPSEPAVVAAARVGVGHAGEWARKPLRFYV

RGSPWVSVVDRVAEQDTQA
```

EndoV nuclease (D35A); mutated residue underlined in bold.

```
                                    (SEQ ID NO: 33)
DLASLRAQQIELASSVIREDRLDKDPPDLIAGAAVGFEQGGEVTRAAMVL

LKYPSLELVEYKVARIATTMPYIPGFLSFREYPALLAAWEMLSQKPDLVF

VDGHGISHPRRLGVASHFGLLVDVPTIGVAKKRLCGKFEPLSSEPGALAP

LMDKGEQLAWVWRSKARCNPLFIATGHRVSVDSALAWVQRCMKGYRLPEP

TRWADAVASERPAFVRYTANQP
```

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLY-QFKNVRWAKGRRETYLC (SEQ ID NO: 5).

The term "nucleic acid programmable DNA binding protein" or "napDNAbp" refers to a protein that associates with a nucleic acid (e.g., DNA or RNA), such as a guide nuclic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a class 2 microbial CRISPR-Cas effector. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNA binding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically listed in this disclosure.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or 1300 amino acids in length. In some embodiments, wild type Cas9 corresponds to Cas9 from *Strepto-* coccus pyogenes (NCBI Reference Sequence: NC_017053.1, SEQ ID NO: 47 (nucleotide); SEQ ID NO: 48 (amino acid)).

(SEQ ID NO: 47)
ATGGATAAGAAATACTCAATAGGCTTAGATATCGGCACAAATAGCGTCGG
ATGGGCGGTGATCACTGATGATTATAAGGTTCCGTCTAAAAAGTTCAAGG
TTCTGGGAAATACAGACCGCCACAGTATCAAAAAAAATCTTATAGGGGCT
CTTTTATTTGGCAGTGGAGAGACAGCGGAAGCGACTCGTCTCAAACGGAC
AGCTCGTAGAAGGTATACACGTCGGAAGAATCGTATTTGTTATCTACAGG
AGATTTTTTCAAATGAGATGGCGAAAGTAGATGATAGTTTCTTTCATCGA
CTTGAAGAGTCTTTTTTGGTGGAAGAAGACAAGAAGCATGAACGTCATCC
TATTTTTGGAAATATAGTAGATGAAGTTGCTTATCATGAGAAATATCCAA
CTATCTATCATCTGCGAAAAAAATTGGCAGATTCTACTGATAAAGCGGAT
TTGCGCTTAATCTATTTGGCCTTAGCGCATATGATTAAGTTTCGTGGTCA
TTTTTTGATTGAGGGAGATTTAAATCCTGATAATAGTGATGTGGACAAAC
TATTTATCCAGTGGTACAAATCTACAATCAATTATTTGAAGAAAACCCT
ATTAACGCAAGTAGAGTAGATGCTAAAGCGATTCTTTCTGCACGATTGAG
TAAATCAAGACGATTAGAAAATCTCATTGCTCAGCTCCCCGGTGAGAAGA
GAAATGGCTTGTTTGGGAATCTCATTGCTTTGTCATTGGGATTGACCCCT
AATTTTAAATCAAATTTTGATTTGGCAGAAGATGCTAAATTACAGCTTTC
AAAAGATACTTACGATGATGATTTAGATAATTTATTGGCGCAAATTGGAG
ATCAATATGCTGATTTGTTTTTGGCAGCTAAGAATTTATCAGATGCTATT
TTACTTTCAGATATCCTAAGAGTAAATAGTGAAATAACTAAGGCTCCCCT
ATCAGCTTCAATGATTAAGCGCTACGATGAACATCATCAAGACTTGACTC
TTTTTAAAAGCTTTAGTTCGACAACAACTTCCAGAAAAGTATAAAGAAATC
TTTTTTGATCAATCAAAAAACGGATATGCAGGTTATATTGATGGGGGAGC
TAGCCAAGAAGAATTTATAAATTTATCAAACCAATTTTAGAAAAAATGG
ATGGTACTGAGGAATTATTGGTGAAACTAAATCGTGAAGATTTGCTGCGC
AAGCAACGGACCTTTGACAACGGCTCTATTCCCCATCAAATTCACTTGGG
TGAGCTGCATGCTATTTTGAGAAGACAAGAAGACTTTTATCCATTTTTAA
AAGACAATCGTGAGAAGATTGAAAAAATCTTGACTTTTCGAATTCCTTAT
TATGTTGGTCCATTGGCGCGTGGCAATAGTCGTTTTGCATGGATGACTCG
GAAGTCTGAAGAAACAATTACCCCATGGAATTTTGAAGAAGTTGTCGATA
AGGTGCTTCAGCTCAATCATTTATTGAACGCATGACAAACTTTGATAAA
AATCTTCCAAATGAAAAGTACTACCAAAACATAGTTTGCTTTATGAGTA
TTTTACGGTTTATAACGAATTGACAAAGGTCAAATATGTTACTGAGGGAA
TGCGAAAACCAGCATTTCTTTCAGGTGAACAGAAGAAAGCCATTGTTGAT
TTACTCTTCAAAACAAATCGAAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGCGCCTACCATGATTTGCTAAAAATT
ATTAAAGATAAAGATTTTTTGGATAATGAAGAAAATGAAGATATCTTAGA
GGATATTGTTTTAACATTGACCTTATTTGAAGATAGGGGGATGATTGAGG

AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTTGA
AATCAGATGGTTTTGCCAATCGCAATTTTATGCAGCTGATCCATGATGAT
AGTTTGACATTTAAAGAAGATATTCAAAAAGCACAGGTGTCTGGACAAGG
CCATAGTTTACATGAACAGATTGCTAACTTAGCTGGCAGTCCTGCTATTA
AAAAAGGTATTTTACAGACTGTAAAAATTGTTGATGAACTGGTCAAAGTA
ATGGGGCATAAGCCAGAAAATATCGTTATTGAAATGGCACGTGAAAATCA
GACAACTCAAAAGGGCCAGAAAAATTCGCGAGAGCGTATGAAACGAATCG
AAGAAGGTATCAAAGAATTAGGAAGTCAGATTCTTAAAGAGCATCCTGTT
GAAAATACTCAATTGCAAAATGAAAGCTCTATCTCTATTATCTACAAAA
TGGAAGAGACATGTATGTGGACCAAGAATTAGATATTAATCGTTTAAGTG
ATTATGATGTCGATCACATTGTTCCACAAAGTTTCATTAAAGACGATTCA
ATAGACAATAAGGTACTAACGCGTTCTGATAAAAATCGTGGTAAATCGGA
TAACGTTCCAAGTGAAGAAGTAGTCAAAAAGATGAAAAACTATTGGAGAC
AACTTCTAAACGCCAAGTTAATCACTCAACGTAAGTTTGATAATTTAACG
AAAGCTGAACGTGGAGGTTTGAGTGAACTTGATAAAGCTGGTTTTATCAA
ACGCCAATTGGTTGAAACTCGCCAAATCACTAAGCATGTGGCACAAATTT
TGGATAGTCGCATGAATACTAAATACGATGAAAATGATAAACTTATTCGA
GAGGTTAAAGTGATTACCTTAAAATCTAAATTAGTTTCTGACTTCCGAAA
AGATTTCCAATTCTATAAAGTACGTGAGATTAACAATTACCATCATGCCC
ATGATGCGTATCTAAATGCCGTCGTTGGAACTGCTTTGATTAAGAAATAT
CCAAAACTTGAATCGGAGTTTGTCTATGGTGATTATAAAGTTTATGATGT
TCGTAAAATGATTGCTAAGTCTGAGCAAGAAATAGGCAAAGCAACCGCAA
AATATTTCTTTTACTCTAATATCATGAACTTCTTCAAAACAGAAATTACA
CTTGCAAATGGAGAGATTCGCAAACGCCCTCTAATCGAAACTAATGGGGA
AACTGGAGAAATTGTCTGGGATAAAGGGCGAGATTTTGCCACAGTGCGCA
AAGTATTGTCCATGCCCCAAGTCAATATTGTCAAGAAAACAGAAGTACAG
ACAGGCGGATTCTCCAAGGAGTCAATTTTACCAAAAAGAAATTCGGACAA
GCTTATTGCTCGTAAAAAAGACTGGGATCCAAAAAAATATGGTGGTTTTG
ATAGTCCAACGGTAGCTTATTCAGTCCTAGTGGTTGCTAAGGTGGAAAAA
GGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTA
AAGGATATAAGGAAGTTAAAAAAGACTTAATCATTAAACTACCTAAATAT
AGTCTTTTTGAGTTAGAAAACGGTCGTAAACGGATGCTGGCTAGTGCCGG
AGAATTACAAAAAGGAAATGAGCTGGCTCTGCCAAGCAAATATGTGAATT
TTTTATATTTAGCTAGTCATTATGAAAAGTTGAAGGGTAGTCCAGAAGAT
AACGAACAAAAACAATTGTTTGTGGAGCAGCATAAGCATTATTTAGATGA
GATTATTGAGCAAATCAGTGAATTTTCTAAGCGTGTTATTTTAGCAGATG
CCAATTTAGATAAAGTTCTTAGTGCATATAACAAACATAGAGACAAACCA

-continued

ATACGTGAACAAGCAGAAAATATTATTCATTTATTTACGTTGACGAATCT

TGGAGCTCCCGCTGCTTTTAAATATTTTGATACAACAATTGATCGTAAAC

GATATACGTCTACAAAAGAAGTTTTAGATGCCACTCTTATCCATCAATCC

ATCACTGGTCTTTATGAAACACGCATTGATTTGAGTCAGCTAGGAGGTGA

CTGA (SEQ ID NO: 48)
MDKKYSIGLDIGTNSVGWAVITDDYKVPSKKFKVLGNTDRHSIKKNLIGA
LLFGSGETAEATRLKRTARRRYTRRKNRICYLQEIFSNEMAKVDDSFFHR
LEESFLVEEDKKHERHPIFGNIVDEVAYHEKYPTIYHLRKKLADSTDKAD
LRLIYLALAHMIKFRGHFLIEGDLNPDNSDVDKLFIQLVQIYNQLFEENP
INASRVDAKAILSARLSKSRRLENLIAQLPGEKRNGLFGNLIALSLGLTP
NFKSNFDLAEDAKLQLSKDTYDDDLDNLLAQIGDQYADLFLAAKNLSDAI
LLSDILRVNSEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGAYHDLLKI
IKDKDFLDNEENEDILEDIVLTLTLFEDRGMIEERLKTYAHLFDDKVMKQ
LKRRRYTGWGRLSRKLINGIRDKQSGKTILDFLKSDGFANRNFMQLIHDD
SLTFKEDIQKAQVSGQGHSLHEQIANLAGSPAIKKGILQTVKIVDELVKV
MGHKPENIVIEMARENQTTQKGQKNSRERMKRIEEGIKELGSQILKEHPV
ENTQLQNEKLYLYYLQNGRDMYVDQELDINRLSDYDVDHIVPQSFIKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD
(single underline: HNH domain; double underline: RuvC domain)

In some embodiments, wild type Cas9 corresponds to, or comprises SEQ ID NO:49 (nucleotide) and/or SEQ ID NO: 50 (amino acid):

(SEQ ID NO: 49)
ATGGATAAAAAGTATTCTATTGGTTTAGACATCGGCACTAATTCCGTTGG

ATGGGCTGTCATAACCGATGAATACAAAGTACCTTCAAAGAAATTTAAGG

TGTTGGGGAACACAGACCGTCATTCGATTAAAAAGAATCTTATCGGTGCC

CTCCTATTCGATAGTGGCGAAACGGCAGAGGCGACTCGCCTGAAACGAAC

CGCTCGGAGAAGGTATACACGTCGCAAGAACCGAATATGTTACTTACAAG

AAATTTTTAGCAATGAGATGGCCAAAGTTGACGATTCTTTCTTTCACCGT

TTGGAAGAGTCCTTCCTTGTCGAAGAGGACAAGAAACATGAACGGCACCC

CATCTTTGGAAACATAGTAGATGAGGTGGCATATCATGAAAAGTACCCAA

CGATTTATCACCTCAGAAAAAAGCTAGTTGACTCAACTGATAAAGCGGAC

CTGAGGTTAATCTACTTGGCTCTTGCCCATATGATAAAGTTCCGTGGGCA

CTTTCTCATTGAGGGTGATCTAAATCCGGACAACTCGGATGTCGACAAAC

TGTTCATCCAGTTAGTACAAACCTATAATCAGTTGTTTGAAGAGAACCCT

ATAAATGCAAGTGGCGTGGATGCGAAGGCTATTCTTAGCGCCCGCCTCTC

TAAATCCCGACGGCTAGAAAACCTGATCGCACAATTACCCGGAGAGAAGA

AAAATGGGTTGTTCGGTAACCTTATAGCGCTCTCACTAGGCCTGACACCA

AATTTTAAGTCGAACTTCGACTTAGCTGAAGATGCCAAATTGCAGCTTAG

TAAGGACACGTACGATGACGATCTCGACAATCTACTGGCACAAATTGGAG

ATCAGTATGCGGACTTATTTTTGGCTGCCAAAAACCTTAGCGATGCAATC

CTCCTATCTGACATACTGAGAGTTAATACTGAGATTACCAAGGCGCCGTT

ATCCGCTTCAATGATCAAAAGGTACGATGAACATCACCAAGACTTGACAC

TTCTCAAGGCCCTAGTCCGTCAGCAACTGCCTGAGAAATATAAGGAAATA

TTCTTTGATCAGTCGAAAAACGGGTACGCAGGTTATATTGACGGCGGAGC

GAGTCAAGAGGAATTCTACAAGTTTATCAAACCCATATTAGAGAAGATGG

ATGGGACGGAAGAGTTGCTTGTAAAACTCAATCGCGAAGATCTACTGCGA

AAGCAGCGGACTTTCGACAACGGTAGCATTCCACATCAAATCCACTTAGG

CGAATTGCATGCTATACTTAGAAGGCAGGAGGATTTTTATCCGTTCCTCA

AAGACAATCGTGAAAAGATTGAGAAAATCCTAACCTTTCGCATACCTTAC

TATGTGGGACCCCTGGCCCGAGGGAACTCTCGGTTCGCATGGATGACAAG

AAAGTCCGAAGAAACGATTACTCCATGGAATTTTGAGGAAGTTGTCGATA

AAGGTGCGTCAGCTCAATCGTTCATCGAGAGGATGACCAACTTTGACAAG

AATTTACCGAACGAAAAAGTATTGCCTAAGCACAGTTTACTTTACGAGTA

TTTCACAGTGTACAATGAACTCACGAAAGTTAAGTATGTCACTGAGGGCA

TGCGTAAACCCGCCTTTCTAAGCGGAGAACAGAAGAAAGCAATAGTAGAT

CTGTTATTCAAGACCAACCGCAAAGTGACAGTTAAGCAATTGAAAGAGGA

CTACTTTAAGAAAATTGAATGCTTCGATTCTGTCGAGATCTCCGGGGTAG

AAGATCGATTTAATGCGTCACTTGGTACGTATCATGACCTCCTAAAGATA

ATTAAAGATAAGGACTTCCTGGATAACGAAGAGAATGAAGATATCTTAGA

AGATATAGTGTTGACTCTTACCCTCTTTGAAGATCGGGAAATGATTGAGG

AAAGACTAAAAACATACGCTCACCTGTTCGACGATAAGGTTATGAAACAG

TTAAAGAGGCGTCGCTATACGGGCTGGGGACGATTGTCGCGGAAACTTAT

CAACGGGATAAGAGACAAGCAAAGTGGTAAAACTATTCTCGATTTTCTAA

AGAGCGACGGCTTCGCCAATAGGAACTTTATGCAGCTGATCCATGATGAC

TCTTTAACCTTCAAAGAGGATATACAAAAGGCACAGGTTTCCGGACAAGG

```
GGACTCATTGCACGAACATATTGCGAATCTTGCTGGTTCGCCAGCCATCA
AAAAGGGCATACTCCAGACAGTCAAAGTAGTGGATGAGCTAGTTAAGGTC
ATGGGACGTCACAAACCGGAAAACATTGTAATCGAGATGGCACGCGAAAA
TCAAACGACTCAGAAGGGGCAAAAAAACAGTCGAGAGCGGATGAAGAGAA
TAGAAGAGGGTATTAAAGAACTGGGCAGCCAGATCTTAAAGGAGCATCCT
GTGGAAAATACCCAATTGCAGAACGAGAAACTTTACCTCTATTACCTACA
AAATGGAAGGGACATGTATGTTGATCAGGAACTGGACATAAACCGTTTAT
CTGATTACGACGTCGATACATTGTACCCCAATCCTTTTTGAAGGACGAT
TCAATCGACAATAAAGTGCTTACACGCTCGGATAAGAACCGAGGGAAAAG
TGACAATGTTCCAAGCGAGGAAGTCGTAAAGAAAATGAAGAACTATTGGC
GGCAGCTCCTAAATGCGAAACTGATAACGCAAAGAAAGTTCGATAACTTA
ACTAAAGCTGAGAGGGGTGGCTTGTCTGAACTTGACAAGGCCGGATTTAT
TAAACGTCAGCTCGTGGAAACCCGCCAATCACAAAGCATGTTGCACAGA
TACTAGATTCCCGAATGAATACGAAATACGACGAGAACGATAAGCTGATT
CGGGAAGTCAAAGTAATCACTTTAAAGTCAAAATTGGTGTCGGACTTCAG
AAAGGATTTTCAATTCTATAAAGTTAGGGAGATAAATAACTACCACCATG
CGCACGACGCTTATCTTAATGCCGTCGTAGGGACCGCACTCATTAAGAAA
TACCCGAAGCTAGAAAGTGAGTTTGTGTATGGTGATTACAAAGTTTATGA
CGTCCGTAAGATGATCGCGAAAAGCGAACAGGAGATAGGCAAGGCTACAG
CCAAATACTTCTTTTATTCTAACATTATGAATTTCTTTAAGACGGAAATC
ACTCTGGCAAACGGAGAGATACGCAAACGACCTTTAATTGAAACCAATGG
GGAGACAGGTGAAATCGTATGGGATAAGGGCCGGGACTTCGCGACGGTGA
GAAAAGTTTTGTCCATGCCCCAAGTCAACATAGTAAAGAAAACTGAGGTG
CAGACCGGAGGGTTTTCAAAGGAATCGATTCTTCCAAAAAGGAATAGTGA
TAAGCTCATCGCTCGTAAAAAGGACTGGGACCCGAAAAAGTACGGTGGCT
TCGATAGCCCTACAGTTGCCTATTCTGTCCTAGTAGTGGCAAAAGTTGAG
AAGGGAAAATCCAAGAAACTGAAGTCAGTCAAAGAATTATTGGGGATAAC
GATTATGGAGCGCTCGTCTTTTGAAAAGAACCCCATCGACTTCCTTGAGG
CGAAAGGTTACAAGGAAGTAAAAAAGGATCTCATAATTAAACTACCAAAG
TATAGTCTGTTTGAGTTAGAAAATGGCCGAAAACGGATGTTGGCTAGCGC
CGGAGAGCTTCAAAAGGGGAACGAACTCGCACTACCGTCTAAATACGTGA
ATTTCCTGTATTTAGCGTCCCATTACGAGAAGTTGAAAGGTTCACCTGAA
GATAACGAACAGAAGCAACTTTTTGTTGAGCAGCACAAACATTATCTCGA
CGAAATCATAGAGCAAATTTCGGAATTCAGTAAGAGAGTCATCCTAGCTG
ATGCCAATCTGGACAAAGTATTAAGCGCATACAACAAGCACAGGGATAAA
CCCATACGTGAGCAGGCGGAAAATATTATCCATTTGTTTACTCTTACCAA
CCTCGGCGCTCCAGCCGCATTCAAGTATTTTGACACAACGATAGATCGCA
AACGATACACTTCTACCAAGGAGGTGCTAGACGCGACACTGATTCACCAA
TCCATCACGGGATTATATGAAACTCGGATAGATTTGTCACAGCTTGGGGG
TGACGGATCCCCCAAGAAGAAGAGGAAAGTCTCGAGCGACTACAAAGACC
ATGACGGTGATTATAAAGATCATGACATCGATTACAAGGATGACGATGAC
AAGGCTGCAGGA (SEQ ID NO: 50)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD
(single underline: HNH domain; double underline:
RuvC domain)
```

In some embodiments, wild type Cas9 corresponds to Cas9 from *Streptococcus pyogenes* (NCBI Reference Sequence: NC_002737.2, SEQ ID NO: 51 (nucleotide); and Uniport Reference Sequence: Q99ZW2, SEQ ID NO: 52 (amino acid).

```
                                    (SEQ ID NO: 51)
ATGGATAAGAAATACTCAATAGGCTTAGATATCGGCACAAATAGCGTCGG
ATGGGCGGTGATCACTGATGAATATAAGGTTCCGTCTAAAAAGTTCAAGG
TTCTGGGAAATACAGACCGCCACAGTATCAAAAAAAATCTTATAGGGGCT
```

-continued

```
CTTTTATTTGACAGTGGAGAGACAGCGGAAGCGACTCGTCTCAAACGGAC
AGCTCGTAGAAGGTATACACGTCGGAAGAATCGTATTTGTTATCTACAGG
AGATTTTTTCAAATGAGATGGCGAAAGTAGATGATAGTTTCTTTCATCGA
CTTGAAGAGTCTTTTTTGGTGGAAGAAGACAAGAAGCATGAACGTCATCC
TATTTTTGGAAATATAGTAGATGAAGTTGCTTATCATGAGAAATATCCAA
CTATCTATCATCTGCGAAAAAATTGGTAGATTCTACTGATAAAGCGGAT
TTGCGCTTAATCTATTTGGCCTTAGCGCATATGATTAAGTTTCGTGGTCA
TTTTTTGATTGAGGGAGATTTAAATCCTGATAATAGTGATGTGGACAAAC
TATTTATCCAGTTGGTACAAACCTACAATCAATTATTTGAAGAAAACCCT
ATTAACGCAAGTGGAGTAGATGCTAAAGCGATTCTTTCTGCACGATTGAG
TAAATCAAGACGATTAGAAAATCTCATTGCTCAGCTCCCCGGTGAGAAGA
AAAATGGCTTATTTGGGAATCTCATTGCTTTGTCATTGGGTTTGACCCCT
AATTTTAAATCAAATTTTGATTTGGCAGAAGATGCTAAATTACAGCTTTC
AAAAGATACTTACGATGATGATTTAGATAATTTATTGGCGCAAATTGGAG
ATCAATATGCTGATTTGTTTTGGCAGCTAAGAATTTATCAGATGCTATT
TTACTTTCAGATATCCTAAGAGTAAATACTGAAATAACTAAGGCTCCCCT
ATCAGCTTCAATGATTAAACGCTACGATGAACATCATCAAGACTTGACTC
TTTTAAAAGCTTTAGTTCGACAACAACTTCCAGAAAAGTATAAAGAAATC
TTTTTTGATCAATCAAAAAACGGATATGCAGGTTATATTGATGGGGGAGC
TAGCCAAGAAGAATTTTATAAATTTATCAAACCAATTTTAGAAAAAATGG
ATGGTACTGAGGAATTATTGGTGAAACTAAATCGTGAAGATTTGCTGCGC
AAGCAACGGACCTTTGACAACGGCTCTATTCCCCATCAAATTCACTTGGG
TGAGCTGCATGCTATTTTGAGAAGACAAGAAGACTTTTATCCATTTTTAA
AAGACAATCGTGAGAAGATTGAAAAAATCTTGACTTTTCGAATTCCTTAT
TATGTTGGTCCATTGGCGCGTGGCAATAGTCGTTTTGCATGGATGACTCG
GAAGTCTGAAGAAACAATTACCCCATGGAATTTTGAAGAAGTTGTCGATA
AAGGTGCTTCAGCTCAATCATTTATTGAACGCATGACAAACTTTGATAAA
AATCTTCCAAATGAAAAGTACTACCAAAACATAGTTTGCTTTATGAGTA
TTTTACGGTTTATAACGAATTGACAAAGGTCAAATATGTTACTGAAGGAA
TGCGAAAACCAGCATTTCTTTCAGGTGAACAGAAGAAAGCCATTGTTGAT
TTACTCTTCAAAACAAATCGAAAAGTAACCGTTAAGCAATTAAAAGAAGA
TTATTTCAAAAAAATAGAATGTTTTGATAGTGTTGAAATTTCAGGAGTTG
AAGATAGATTTAATGCTTCATTAGGTACCTACCATGATTTGCTAAAAATT
ATTAAAGATAAAGATTTTTTGGATAATGAAGAAAATGAAGATATCTTAGA
GGATATTGTTTTAACATTGACCTTATTTGAAGATAGGGAGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTGA
AATCAGATGGTTTTGCCAATCGCAATTTTATGCAGCTGATCCATGATGAT
AGTTTGACATTTAAAGAAGACATTCAAAAAGCACAAGTGTCTGGACAAGG
CGATAGTTTACATGAACATATTGCAAATTTAGCTGGTAGCCCTGCTATTA
AAAAAGGTATTTTACAGACTGTAAAAGTTGTTGATGAATTGGTCAAAGTA
ATGGGGCGGCATAAGCCAGAAAATATCGTTATTGAAATGGCACGTGAAAA
TCAGACAACTCAAAAGGGCCAGAAAAATTCGCGAGAGCGTATGAAACGAA
TCGAAGAAGGTATCAAAGAATTAGGAAGTCAGATTCTTAAAGAGCATCCT
GTTGAAAATACTCAATTGCAAATGAAAAGCTCTATCTCTATTATCTCCA
AAATGGAAGAGACATGTATGTGGACCAAGAATTAGATATTAATCGTTTAA
GTGATTATGATGTCGATCACATTGTTCCACAAAGTTTCCTTAAAGACGAT
TCAATAGACAATAAGGTCTTAACGCGTTCTGATAAAAATCGTGGTAAATC
GGATAACGTTCCAAGTGAAGAAGTAGTCAAAAAGATGAAAAACTATTGGA
GACAACTTCTAAACGCCAAGTTAATCACTCAACGTAAGTTTGATAATTTA
ACGAAAGCTGAACGTGGAGGTTTGAGTGAACTTGATAAAGCTGGTTTTAT
CAAACGCCAATTGGTTGAAACTCGCCAAATCACTAAGCATGTGGCACAAA
TTTTGGATAGTCGCATGAATACTAAATACGATGAAAATGATAAACTTATT
CGAGAGGTTAAAGTGATTACCTTAAAATCTAAATTAGTTTCTGACTTCCG
AAAAGATTTCCAATTCTATAAAGTACGTGAGATTAACAATTACCATCATG
CCCATGATGCGTATCTAAATGCCGTCGTTGGAACTGCTTTGATTAAGAAA
TATCCAAAACTTGAATCGGAGTTTGTCTATGGTGATTATAAAGTTTATGA
TGTTCGTAAAATGATTGCTAAGTCTGAGCAAGAAATAGGCAAAGCAACCG
CAAAATATTTCTTTTACTCTAATATCATGAACTTCTTCAAAACAGAAATT
ACACTTGCAAATGGAGAGATTCGCAAACGCCCTCTAATCGAAACTAATGG
GGAAACTGGAGAAATTGTCTGGGATAAAGGGCGAGATTTTGCCACAGTGC
GCAAAGTATTGTCCATGCCCCAAGTCAATATTGTCAAGAAAACAGAAGTA
CAGACAGGCGGATTCTCCAAGGAGTCAATTTTACCAAAAAGAAATTCGGA
CAAGCTTATTGCTCGTAAAAAAGACTGGGATCCAAAAAAATATGGTGGTT
TTGATAGTCCAACGGTAGCTTATTCAGTCCTAGTGGTTGCTAAGGTGGAA
AAAGGGAAATCGAAGAAGTTAAAATCCGTTAAAGAGTTACTAGGGATCAC
AATTATGGAAAGAAGTTCCTTTGAAAAAAATCCGATTGACTTTTTAGAAG
CTAAAGGATATAAGGAAGTTAAAAAAGACTTAATCATTAAACTACCTAAA
TATAGTCTTTTTGAGTTAGAAAACGGTCGTAAACGGATGCTGGCTAGTGC
CGGAGAATTACAAAAAGGAAATGAGCTGGCTCTGCCAAGCAAATATGTGA
ATTTTTTATATTTAGCTAGTCATTATGAAAAGTTGAAGGGTAGTCCAGAA
GATAACGAACAAAAACAATTGTTTGTGGAGCAGCATAAGCATTATTTAGA
TGAGATTATTGAGCAAATCAGTGAATTTTCTAAGCGTGTTATTTTAGCAG
ATGCCAATTTAGATAAAGTTCTTAGTGCATATAACAAACATAGAGACAAA
CCAATACGTGAACAAGCAGAAAATATTATTCATTTATTTACGTTGACGAA
TCTTGGAGCTCCCGCTGCTTTTAAATATTTTGATACAACAATTGATCGTA
AACGATATACGTCTACAAAAGAAGTTTTAGATGCCACTCTTATCCATCAA
TCCATCACTGGTCTTTATGAAACACGCATTGATTTGAGTCAGCTAGGAGG
TGACTGA
```

-continued (SEQ ID NO: 52)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(single underline: HNH domain; double underline:
RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation of SEQ ID NO: 52 or corresponding mutations in another Cas9. In some embodiments, the dCas9 comprises the amino acid sequence of SEQ ID NO: 53 dCas9 (D10A and H840A):

(SEQ ID NO: 53)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(single underline: HNH domain; double underline:
RuvC domain).

Figure 94:
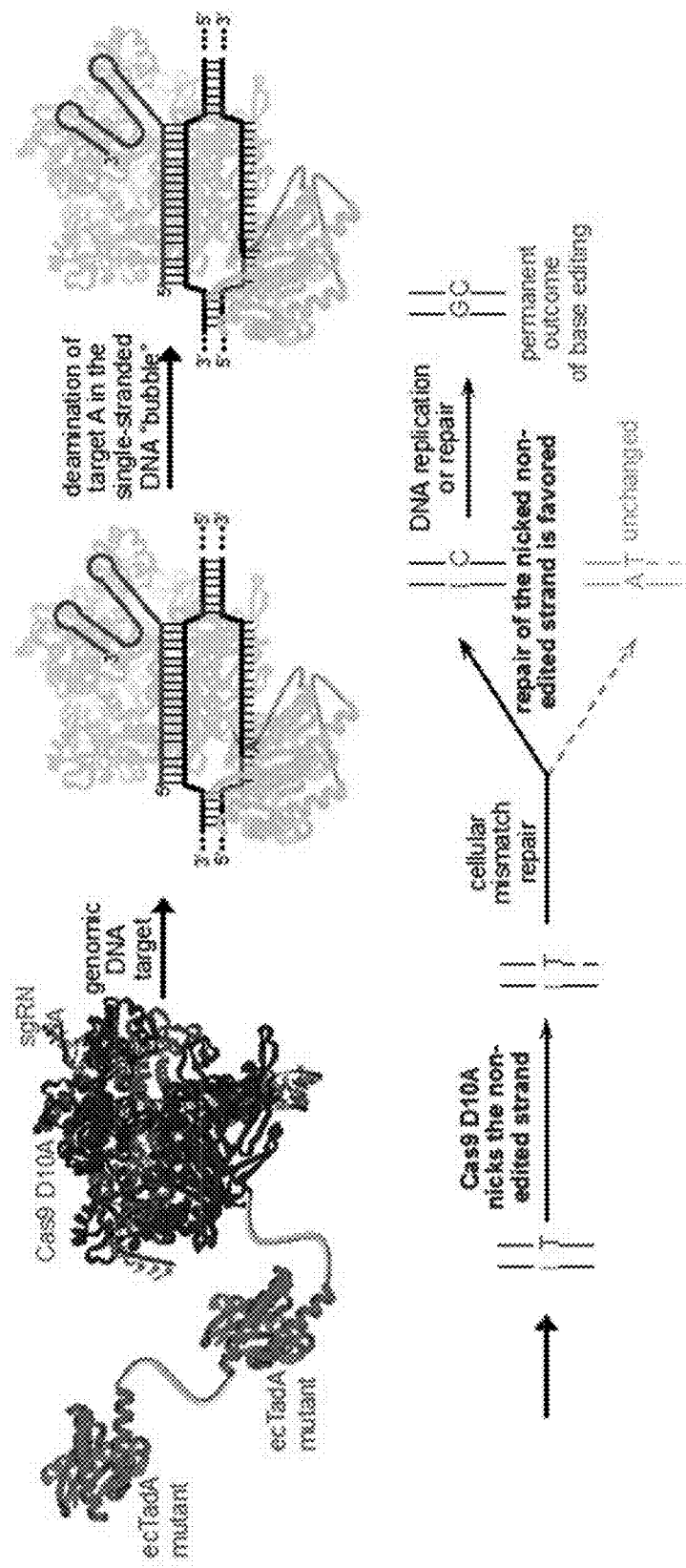
FIG. 94 shows a schematic representation of an exemplary adenosine base editing process.
Figure 95:
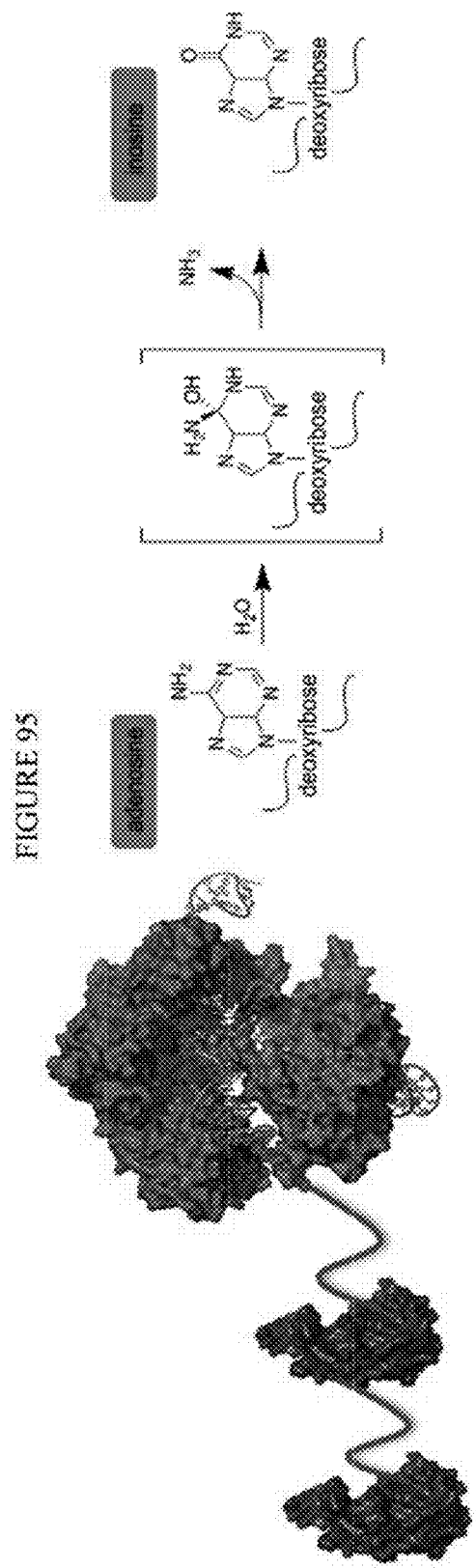
FIG. 95 shows a schematic representation of an exemplary adenosine base editor, which deaminates adenosine to inosine.

In some embodiments, the Cas9 domain comprises a D10A mutation, while the residue at position 840 remains a histidine in the amino acid sequence provided in SEQ ID NO: 52, or at corresponding positions in any of the amino acid sequences provided in SEQ ID NOs: 108-357. Without wishing to be bound by any particular theory, the presence of the catalytic residue H840 maintains the activity of the Cas9 to cleave the non-edited (e.g., non-deaminated) strand containing a T opposite the targeted A. Restoration of H840 (e.g., from A840 of a dCas9) does not result in the cleavage of the target strand containing the A. Such Cas9 variants are able to generate a single-strand DNA break (nick) at a specific location based on the gRNA-defined target sequence, leading to repair of the non-edited strand, ultimately resulting in a T to C change on the non-edited strand. A schematic representation of this process is shown in FIG. 94. Briefly, and without wishing to be bound by any particular theory, the A of a A-T base pair can be deaminated to a inosine (I) by an adenosine deaminase, e.g., an engineered adenosine deaminase that deaminates an adenosine in DNA. Nicking the non-edited strand, having the T, facilitates removal of the T via mismatch repair mechanisms. A UGI domain or a catalytically inactive inosine-specific nuclease (dISN) may inhibit inosine-specific nucleases (e.g., sterically) thereby preventing removal of the inosine (I).

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 53) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 53) are provided having amino acid sequences which are shorter, or longer than SEQ ID NO: 53, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 34). In some embodiments, the Cas9 protein is a Cas9 nickase (nCas9). In some embodiments, the nCas9 comprises the amino acid sequence (SEQ ID NO: 35). In some embodiments, the Cas9 protein is a nuclease active Cas9. In some embodiments, the nuclease active Cas9 comprises the amino acid sequence (SEQ ID NO: 36).

Exemplary catalytically inactive Cas9 (dCas9):
(SEQ ID NO: 34)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDAIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary Cas9 nickase (nCas9):
(SEQ ID NO: 35)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

```
FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary catalytically active Cas9:
                                    (SEQ ID NO: 36)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD.
```

In some embodiments, Cas9 refers to a Cas9 from arehaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 417-419. In some embodiments, the napDNAbp comprises an amino acid sequence of any one SEQ ID NOs: 417-419. It should be appreciated that CasX and CasY from other bacterial species may also be used in accordance with the present disclosure.

CasX (uniprot.org/uniprot/F0NN87;
uniprot.org/uniprot/F0NH53)
>tr|F0NN87|F0NN87_SULIH CRISPR-associated Casx
protein OS = Sulfolobus islandicus
(strain HVE10/4) GN = SiH_0402 PE = 4 SV = 1
(SEQ ID NO: 417)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYEFGRSPGMVERTRRVKLE

VEPHYLIIAAAGWVLTRLGKAKVSEGDYVGVNVFTPTRGILYSLIQNVNG

IVPGIKPETAFGLWIARKVVSSVTNPNVSVVRIYTISDAVGQNPTTINGG

FSIDLTKLLEKRYLLSERLEAIARNALSISSNMRERYIVLANYIYEYLTG

SKRLEDLLYFANRDLIMNLNSDDGKVRDLKLISAYVNGELIRGEG

>tr|F0NH53|F0NH53_SULIR CRISPR associated protein,
Casx OS = Sulfolobus islandicus (strain REY15A)
GN = SiRe_0771 PE = 4 SV = 1
(SEQ ID NO: 418)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLTG

SKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY
[uncultured Parcubacteria group bacterium]
(SEQ ID NO: 419)
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPPEKSAEEEGQRYLGIDIGEYGIAYTALEIT

GDSAKILDQNFISDPQLKTLREEVKGLKLDQRRGTFAMPSTKIARIRESL

VHSLRNRIHHLALKHKAKIVYELEVSRFEEGKQKIKKVYATLKKADVYSE

IDADKNLQTTVWGKLAVASEISASYTSQFCGACKKLWRAEMQVDETITTQ

ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI

The term "effective amount," as used herein, refers to an amount of a biologically active agent that is sufficient to elicit a desired biological response. For example, in some embodiments, an effective amount of a nucleobase editor may refer to the amount of the nucleobase editor that is sufficient to induce mutation of a target site specifically bound mutated by the nucleobase editor. In some embodiments, an effective amount of a fusion protein provided herein, e.g., of a fusion protein comprising a nucleic acid programmable DNA binding protein and a deaminase domain (e.g., an adenosine deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nucleobase editor, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821(2012), the entire contents of which is incorporated herein by reference. Other examples of gRNAs (e.g., those including domain 2) can be found in U.S. Provisional Patent Application, U.S.S.N. 61/874,682, filed Sep. 6, 2013, entitled "Switchable Cas9 Nucleases And Uses Thereof," and U.S. Provisional Patent Application, U.S.S.N. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference.

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); *Mali*, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M. et al., RNA-programmed genome editing in human cells. *eLife* 2, e00471 (2013); Dicarlo, J. E. et al., Genome engineering in *Saccharomyces cerevisiae* using CRISPR-Cas systems. Nucleic acids research (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-adenosine deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

DETAILED DESCRIPTION OF THE INVENTION

Some aspects of this disclosure relate to proteins that deaminate the nucleobase adenine. This disclosure provides adenosine deaminase proteins that are capable of deaminating (i.e., removing an amine group) adenine of a deoxyadenosine residue in deoxyribonucleic acid (DNA). For example, the adenosine deaminases provided herein are capable of deaminating adenine of a deoxyadenosine residue of DNA. It should be appreciated that there were no known adenosine deaminases capable of deaminating deoxyadenosine in DNA before the present invention. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf1 protein) capable of binding to a specific nucleotide sequence. The deamination of an adenosine by an adenosine deaminase can lead to a point mutation, this process is referred to herein as nucleic acid editing. For example, the adenosine may be converted to an inosine residue, which typically base pairs with a cytosine residue. Such fusion proteins are useful inter alia for targeted editing of nucleic acid sequences. Such fusion proteins may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases that can be treated by making an A to G, or a T to C mutation may be treated using the nucleobase editors provided herein. The invention provides deaminases, fusion proteins, nucleic acids, vectors, cells, compositions, methods, kits, systems, etc. that utilize the deaminases and nucleobase editors.

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein may comprise a Cas9 domain that has reduced nuclease activity. In some embodiments, the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, any of the fusion proteins provided herein further comprise an inhibitor of inosine base excision repair, for example, a uracil glycosylase inhibitor (UGI) domain or a catalytically inactive inosine-specific nuclease (dISN). Without wishing to be bound by any particular theory, the UGI domain or dISN may inhibit or prevent base excision repair of a deaminated adenosine residue (e.g., inosine), which may improve the activity or efficiency of the base editor.

Adenosine Deaminases

Some aspects of the disclosure provide adenosine deaminases. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

Figure 92:
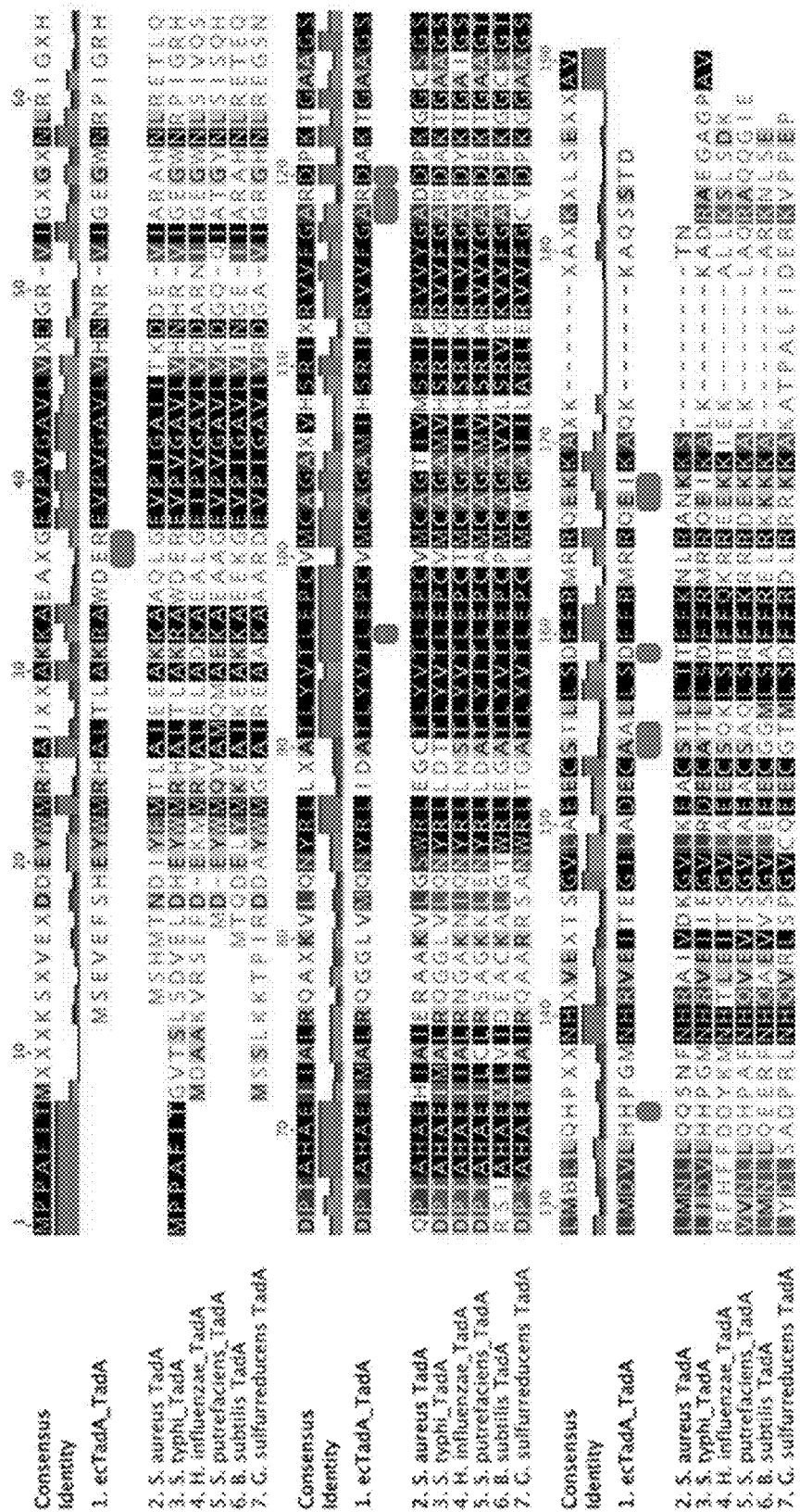
FIG. 92 shows a sequence alignment of prokaryotic TadA amino acid sequences. The sequences correspond to SEQ ID NOs: 634-657 from top to bottom respectively.
Figure 93:
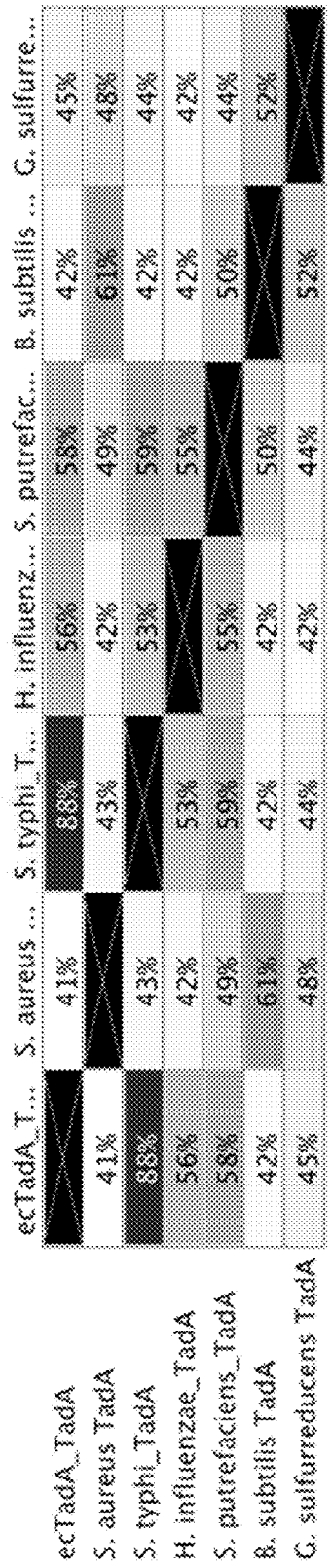
FIG. 93 shows a schematic of the relative sequence identity analysis of TadA amino acid sequences.

Exemplary alignment of prokaryotic TadA proteins is shown in FIG. 92. The residues highlighted in blue are the residues which may be important for catalyzing A to I deamination on ssDNA. Accordingly, it should be appreciated that any of the mutations identified in ecTadA provided herein may be made in any homologous residue in another adenine deaminase, for example, a TadA deaminase from another bacterium. FIG. 93 shows the relative sequence identity analysis (heatmap of sequence identity):

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. It should be appreciated that adenosine deaminases provided herein may include one or more mutations (e.g., any of the mutations provided herein). The disclosure provides any deaminase domains with a certain percent identiy plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 1, 64-84, 420-437, 672-684, or any of the adenosine deaminases provided herein.

Evolution #1 and #2 Mutations

In some embodiments, the adenosine deaminase comprises a D108X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 1, or a corresponding mutation in another adenosine deaminase. An exemplary alignment of deaminases is shown in FIG. 92. It should be appreciated, however, that additional deaminases may similarly be aligned to identify homologous amino acid residues that can be mutated as provided herein.

In some embodiments, the adenosine deaminse comprises an A106X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 1, or a corresponding mutation in another adenosine deaminase.

In some embodiments, the adenosine deaminase comprises a E155X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 1, or a corresponding mutation in another adenosine deaminase.

In some embodiments, the adenosine deaminase comprises a D147X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in SEQ ID NO: 1, or a corresponding mutation in another adenosine deaminase.

It should be appreciated that any of the mutations provided herein (e.g., based on the ecTadA amino acid sequence of SEQ ID NO: 1) may be introduced into other adenosine deaminases, such as *S. aureus* TadA (saTadA), or other adenosine deaminases (e.g., bacterial adenosine deaminases). It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 1, or a corresponding mutation in another adenosine deaminase. In some embodiments, an adenosine deaminase comprises the following group of mutations (groups of mutations are separated by a ";") in ecTadA SEQ ID NO: 1, or corresponding mutations in another adenosine deaminase: D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA). In some embodiments, an adenosine deaminase comprises one or more of the mutations shown in Table 4, which identifies individual mutations and combinations of mutations made in ecTadA and saTadA. In some embodiments, an adenosine deaminase comprises a mutation or combination of mutations shown in Table 4.

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T175, L18E, W23L, L34S, W45L, R51H, A56E, or A565, E59G, E85K, or E85G, M94L, 1951, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in SEQ ID NO: 1, or one or more corresponding mutations in another adenosine deaminase. In some embodiments, the adenosine deaminase comprises one or more of the mutations provided in FIG. 11 corresponding to SEQ ID NO: 1, or one or more corresponding mutations in another adenosine deaminase. In some embodiments, the adenosine deaminase comprises the mutation or mutations of any one of constructs 1-16 shown in FIG. 11 or in any one of the constructs shown in Table 4 corresponding to SEQ ID NO: 1, or a corresponding mutation or mutations in another adenosine deaminase.

In some embodiments, the adenosine deaminase comprises one or more of a H8X, D108X, and/or N127X mutation in SEQ ID NO: 1, or one or more corresponding mutations in another adenosine deaminase, where X indicates the presence of any amino acid. In some embodiments, the adenosine deaminase comprises one or more of a H8Y, D108N, and/or N127S mutation in SEQ ID NO: 1, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in SEQ ID NO: 1, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in SEQ ID NO: 1, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of H8X, A106X, D108X, N127X, E155X, and K161X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in SEQ ID NO: 1, or a corresponding mutation or mutations in another adenosine deaminase. In some embodiments, the adenosine deaminase comprises one, two, three, four, or five, mutations selected from the group consisting of H8Y, D108N, N127S, E155V, and T166P in SEQ ID NO: 1, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, D108N, A109T, N127S, and E155G in SEQ ID NO: 1, or a corresponding mutation or mutations in another adenosine deaminase.

In some embodiments, the adenosine deaminase comprises one or more of the mutations provided in FIG. 16 corresponding to SEQ ID NO: 1, or one or more corresponding mutations in another adenosine deaminase. In some embodiments, the adenosine deaminase comprises the mutations of any one of constructs pNMG-149 to pNMG-154 of FIG. 16, corresponding to SEQ ID NO: 1, or corresponding mutations in another adenosine deaminase. In some embodiments, the adenosine deaminase comprises a D108N, D108G, or D108V mutation in SEQ ID NO: 1, or corresponding mutations in another adenosine deaminase. In some embodiments, the adenosine deaminase comprises a A106V and D108N mutation in SEQ ID NO: 1, or corresponding mutations in another adenosine deaminase. In some embodiments, the adenosine deaminase comprises R107C and D108N mutations in SEQ ID NO: 1, or corresponding mutations in another adenosine deaminase. In some embodiments, the adenosine deaminase comprises a H8Y, D108N, N127S, D147Y, and Q154H mutation in SEQ ID NO: 1, or corresponding mutations in another adenosine deaminase. In some embodiments, the adenosine deaminase comprises a H8Y, R24W, D108N, N127S, D147Y, and E155V mutation in SEQ ID NO: 1, or corresponding mutations in another adenosine deaminase. In some embodiments, the adenosine deaminase comprises a D108N, D147Y, and E155V mutation in SEQ ID NO: 1, or corresponding mutations in another adenosine deaminase. In some embodiments, the adenosine deaminase comprises a H8Y, D108N, and S127S mutation in SEQ ID NO: 1, or corresponding mutations in another adenosine deaminase. In some embodiments, the adenosine deaminase comprises a A106V, D108N, D147Y and E155V mutation in SEQ ID NO: 1, or corresponding mutations in another adenosine deaminase.

Figures 96, 97:
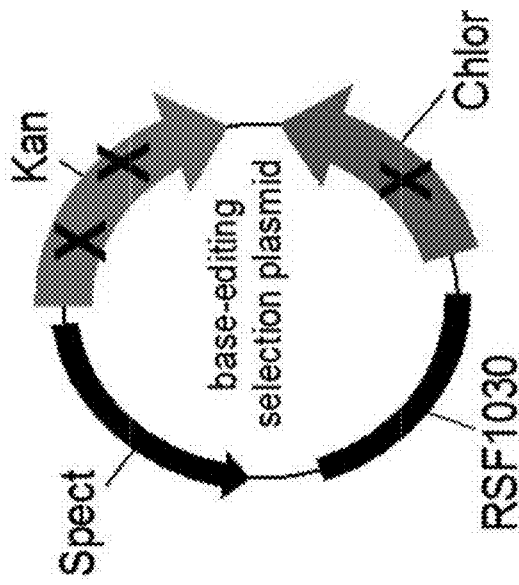
FIG. 96 shows a schematic of an exemplary base-editing selection plasmid.
FIG. 97 shows a list of clones including identified mutations in ecTadA.
Figure 98:
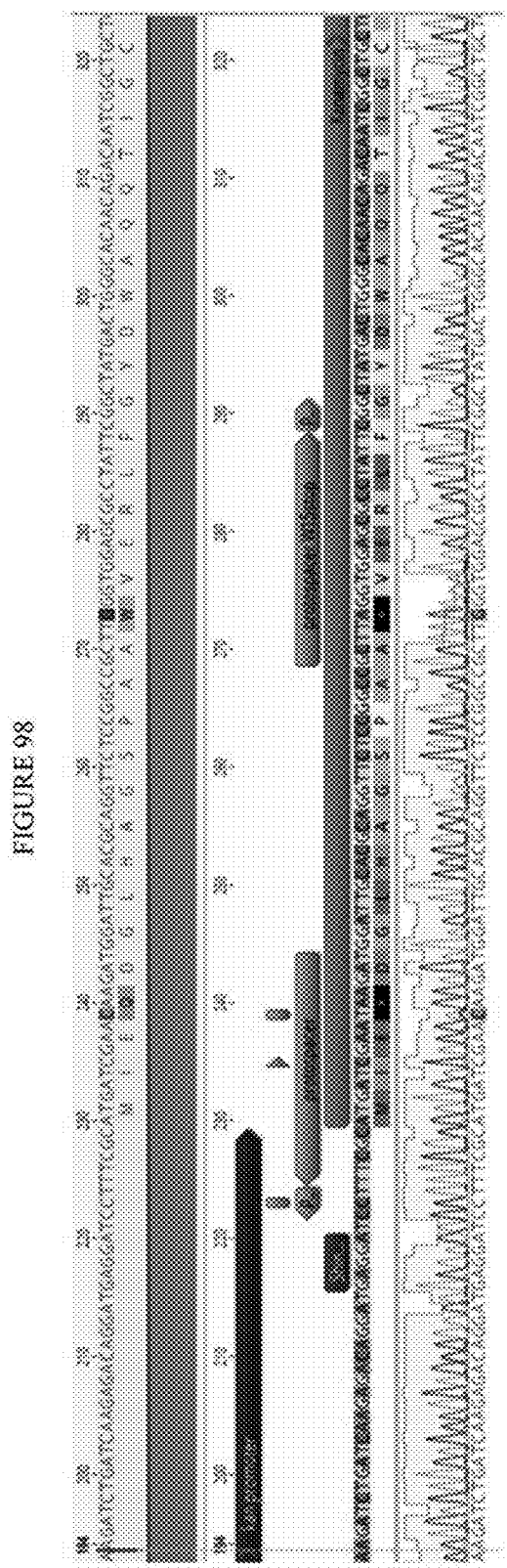
FIG. 98 shows an exemplary sequencing analysis of a selection plasmid from surviving colonies. The sequences correspond to SEQ ID NOs: 658-661 from top to bottom respectively.
Figures 99, 100:
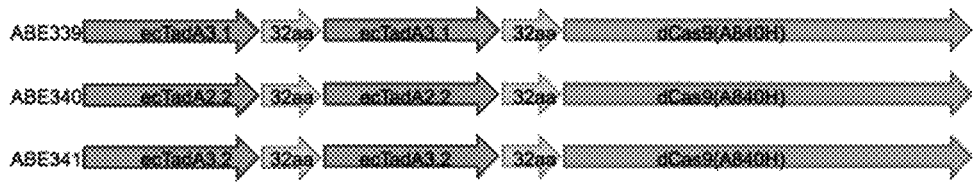
FIG. 99 shows a schematic of exemplary adenosine base editors from a third round of evolution.
FIG. 100 shows the percentage of A to G conversions in Hek293T cells.
Figure 101:
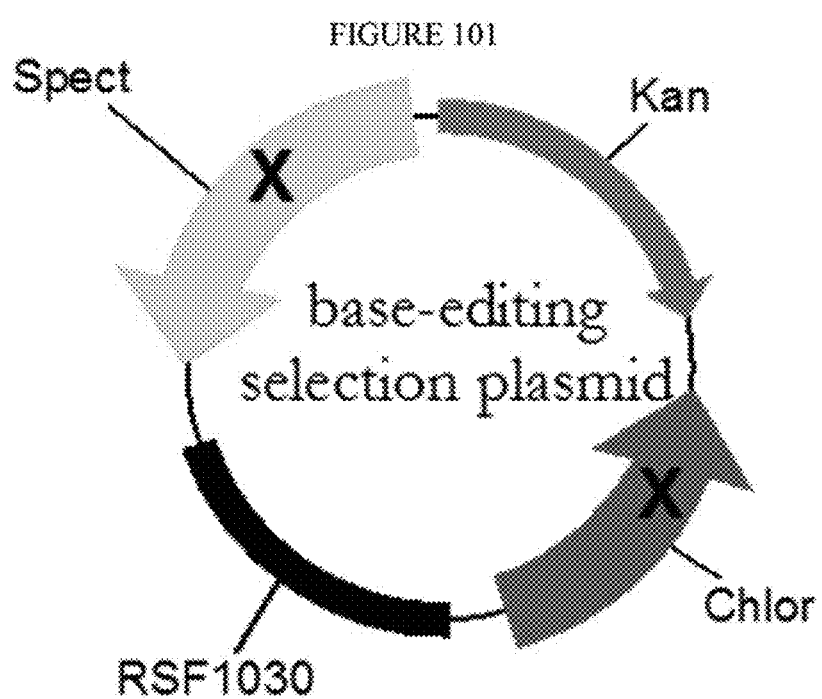
FIG. 101 shows a schematic of an exemplary base-editing selection plasmid.
Figure 102:
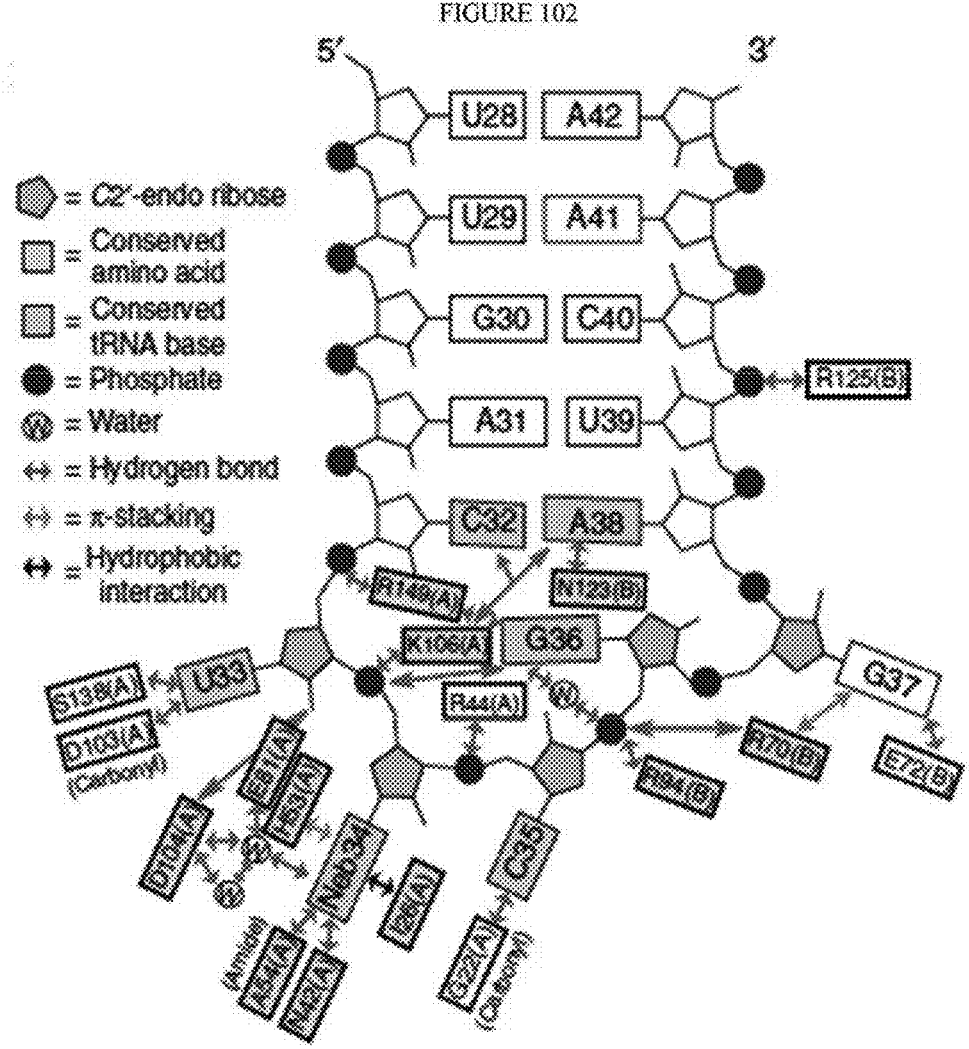
FIG. 102 shows a schematic representation of the verdine crystal structure of *S. aureus* TadA. The *S. aureus* TadA, a homolog of ecTadA, is shown with its tRNA substrate co-crystalized. Red arrows are the H-bond contacts with the various nucleic acids in the tRNA substrate. See Losey, H. C., et al., "Crystal structure of *Staphylococcus* sureus tRNA adenosine deaminase tadA in complex with RNA", *Nature Struct. Mol. Biol.* 2, 153-159 (2006).
Figure 103:
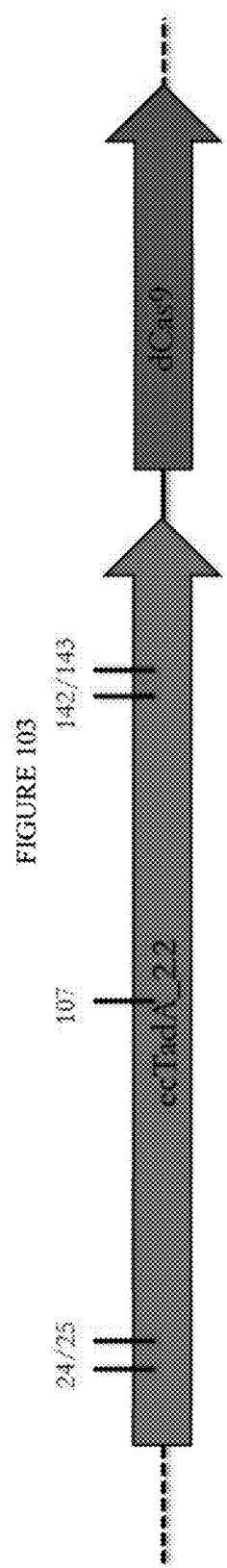
FIG. 103 shows a schematic of a construct containing ecTadA_2.2 and dCas9, identifying mutated ecTadA residues.
Figure 104:
FIG. 104 shows results of ecTadA evolution (evolution #4) at sites E25 and R26.
Figure 105:
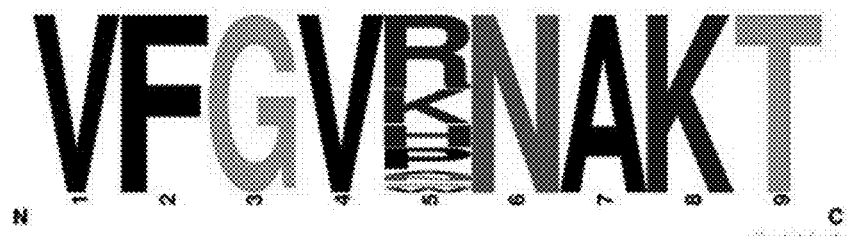
FIG. 105 shows results of ecTadA evolution (evolution #4) at site R107.
Figure 106:
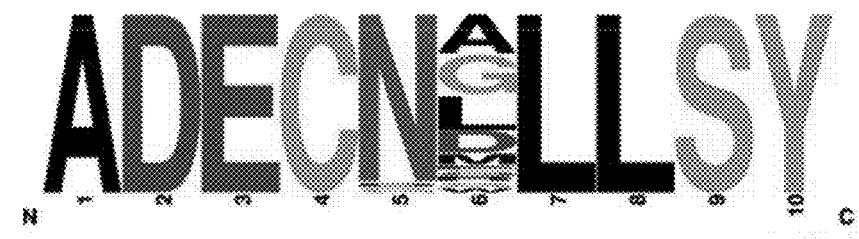
FIG. 106 shows results of ecTadA evolution (evolution #4) at sites A142 and A143.
Figure 107:
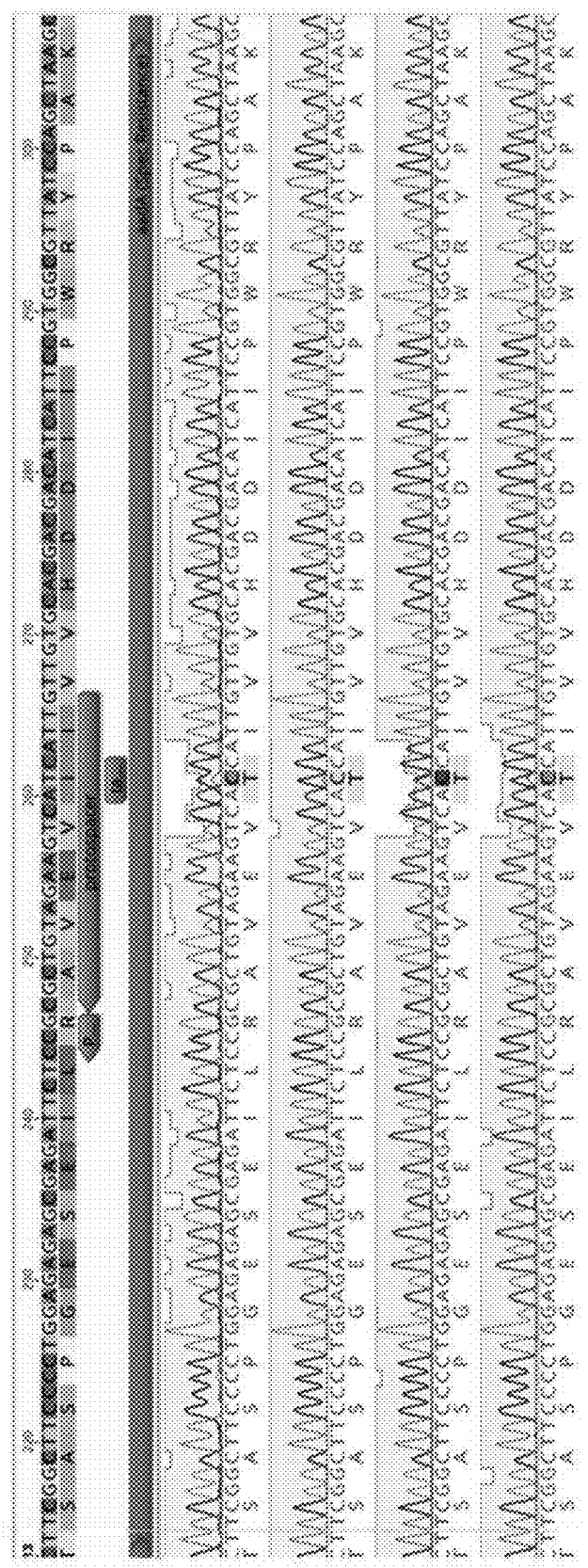
FIG. 107 shows an exemplary sequencing analysis of a selection plasmid from surviving colonies. The sequences correspond to SEQ ID NO: 662-671 from top to bottom respectively.

In some embodiments, the adenosine deaminase comprises one or more of a, S2X, H8X, I49X, L84X, H123X, N127X, I156X and/or K160X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K1605 mutation in SEQ ID NO: 1, or one or more corresponding mutations in another adenosine deaminase. In some embodiments, the adenosine deaminase comprises one or more of the mutations provided in FIG. 97 corresponding to SEQ ID NO: 1, or one or more corresponding mutations in another adenosine deaminase. In some embodiments, the adenosine deaminase comprises the mutation or mutations of any one of clones 1-3 shown in FIG. 97 corresponding to SEQ ID NO: 1, or a corresponding mutation or mutations in another adenosine deaminase.

In some embodiments, the adenosine deaminse comprises an L84X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an L84F mutation in SEQ ID NO: 1, or a corresponding mutation in another adenosine deaminase.

In some embodiments, the adenosine deaminse comprises an H123X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 1, or a corresponding mutation in another adenosine deaminase.

In some embodiments, the adenosine deaminse comprises an I157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an I157F mutation in SEQ ID NO: 1, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in SEQ ID NO: 1, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, A106T, D108N, N127S, and K1605 in SEQ ID NO: 1, or a corresponding mutation or mutations in another adenosine deaminase.

In some embodiments, the adenosine deaminase comprises one or more of a, E25X, R26X, R107X, A142X, and/or A143X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E255, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in SEQ ID NO: 1, or one or more corresponding mutations in another adenosine deaminase. In some embodiments, the adenosine deaminase comprises one or more of the mutations provided in Table 7 corresponding to SEQ ID NO: 1, or one or more corresponding mutations in another adenosine deaminase. In some embodiments, the adenosine deaminase comprises the mutation or mutations of any one of clones 1-22 shown in Table 7 corresponding to SEQ ID NO: 1, or a corresponding mutation or mutations in another adenosine deaminase.

In some embodiments, the adenosine deaminse comprises an E25X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in SEQ ID NO: 1, or a corresponding mutation in another adenosine deaminase.

In some embodiments, the adenosine deaminse comprises an R26X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an, R26G, R26N, R26Q, R26C, R26L, or R26K mutation in SEQ ID NO: 1, or a corresponding mutation in another adenosine deaminase.

In some embodiments, the adenosine deaminse comprises an R107X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in SEQ ID NO: 1, or a corresponding mutation in another adenosine deaminase.

In some embodiments, the adenosine deaminse comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 1, or a corresponding mutation in another adenosine deaminase.

In some embodiments, the adenosine deaminse comprises an A143X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in SEQ ID NO: 1, or a corresponding mutation in another adenosine deaminase.

In some embodiments, the adenosine deaminase comprises one or more of a, H36X, N37X, P48X, I49X, R51X, M70X, N72X, D77X, E134X, S146X, Q154X, K157X, and/or K161X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in SEQ ID NO: 1, or one or more corresponding mutations in another adenosine deaminase. In some embodiments, the adenosine deaminase comprises one or more of the mutations provided in any one of FIGS. 125-128 corresponding to SEQ ID NO: 1, or one or more corresponding mutations in another adenosine deaminase. In some embodiments, the adenosine deaminase comprises the mutation or mutations of any one of clones 1-11 shown in any one of FIGS. 125-128 corresponding to SEQ ID NO: 1, or a corresponding mutation or mutations in another adenosine deaminase.

In some embodiments, the adenosine deaminse comprises an H36X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 1, or a corresponding mutation in another adenosine deaminase.

In some embodiments, the adenosine deaminse comprises an N37X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 1, or a corresponding mutation in another adenosine deaminase.

In some embodiments, the adenosine deaminse comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an P48T, or P48L mutation in SEQ ID NO: 1, or a corresponding mutation in another adenosine deaminase.

In some embodiments, the adenosine deaminse comprises an R51X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 1, or a corresponding mutation in another adenosine deaminase.

In some embodiments, the adenosine deaminse comprises an S146X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an S146R, or S146C mutation in SEQ ID NO: 1, or a corresponding mutation in another adenosine deaminase.

In some embodiments, the adenosine deaminse comprises an K157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 1, or a corresponding mutation in another adenosine deaminase.

In some embodiments, the adenosine deaminse comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in SEQ ID NO: 1, or a corresponding mutation in another adenosine deaminase.

In some embodiments, the adenosine deaminse comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a A142N mutation in SEQ ID NO: 1, or a corresponding mutation in another adenosine deaminase.

In some embodiments, the adenosine deaminse comprises an W23X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 1, or a corresponding mutation in another adenosine deaminase.

In some embodiments, the adenosine deaminse comprises an R152X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 1, or a corresponding mutation in another adenosine deaminase.

It should be appreciated that the adenosine deaminase (e.g., a first or second adenosine deaminase) may comprise one or more of the mutations provided in any of the adenosine deaminases (e.g., ecTadA adenosine deaminases) shown in Table 4. In some embodiments, the adenosine deaminase comprises the combination of mutations of any of the adenosine deaminases (e.g., ecTadA adenosine deaminases) shown in Table 4. For example, the adenosine deaminase may comprise the mutations H36L, R51L, L84F, A106V, D108N, H123Y, S146C, D147Y, E155V, I156F, and K157N, which are shown in the second ecTadA (relative to SEQ ID NO: 1) of clone pNMG-477. In some embodiments, the adenosine deaminase comprises the following combination of mutations relative to SEQ ID NO:1, where each mutation of a combination is separated by a "_" and each combination of mutations is between parentheses:
(A106V_D108N), (R107C_D108N), (H8Y_D108N_S127S_D147Y_Q154H), (H8Y_R24W_D108N_N127S_D147Y_E155V), (D108N_D147Y_E155V), (H8Y_D108N_S127S), (H8Y_D108N_N127S_D147Y_Q154H), (A106V_D108N_D147Y_E155V), (D108Q_D147Y_E155V), (D108M_D147Y_E155V), (D108L_D147Y_E155V), (D108K_D147Y_E155V), (D108I_D147Y_E155V), (D108F_D147Y_E155V), (A106V_D108N_D147Y), (A106V_D108M_D147Y_E155V), (E59A_A106V_D108N_D147Y_E155V), (E59A cat dead_A106V_D108N_D147Y_E155V), (L84F_A106V_D108N_H123Y_D147Y_E155V_I156Y), (L84F_A106V_D108N_H123Y_D147Y_E155V_I156F), (D103A_D014N), (G22P_D103A_D104N), (G22P_D103A_D104N_S138A), (D103A_D104N_S138A), (R26G_L84F_A106V_R107H_D108N_H123Y_A142N_A143D_D147Y_E155V_I156F), (E25G_R26G_L84F_A106V_R107H_D108N_H123Y_A142N_A143D_D147Y_E155V_I156F), (E25D_R26G_L84F_A106V_R107K_D108N_H123Y_A142N_A143G_D147Y_E155V_I156F), (R26Q_L84F_A106V_D108N_H123Y_A142N_D147Y_E155V_I156F), (E25M_R26G_L84F_A106V_R107P_D108N_H123Y_A142N_A143D_D147Y_E155V_I156F), (R26C_L84F_A106V_R107H_D108N_H123Y_A142N_D147Y_E155V_I156F), (L84F_A106V_D108N_H123Y_A142N_A143L_D147Y_E155V_I156F), (R26G_L84F_A106V_D108N_H123Y_A142N_D147Y_E155V_I156F), (E25A_R26G_L84F_A106V_R107N_D108N_H123Y_A142N_A143E_D147Y_E155V_I156F), (R26G_L84F_A106V_R107H_D108N_H123Y_A142N_A143D_D147Y_E155V_I156F), (A106V_D108N_A142N_D147Y_E155V), (R26G_A106V_D108N_A142N_D147Y_E155V), (E25D_R26G_A106V_R107K_D108N_A142N_A143G_D147Y_E155V), (R26G_A106V_D108N_R107H_A142N_A143D_D147Y_E155V), (E25D_R26G_A106V_D108N_A142N_D147Y_E155V), (A106V_R107K_D108N_A142N_D147Y_E155V), (A106V_D108N_A142N_A143G_D147Y_E155V), (A106V_D108N_A142N_A143L_D147Y_E155V), (H36L_R51L_L84F_A106V_D108N_H123Y_S146C_D147Y_E155V_I156F_K157N), (N37T_P48T_M70L_L84F_A106V_D108N_H123Y_D147Y_I49V_E155V_I156F), (N37S_L84F_A106V_D108N_H123Y_D147Y_E155V_I156F_K161T), (H36L_L84F_A106V_D108N_H123Y_D147Y_Q154H_E155V_I156F), (N72S_L84F_A106V_D108N_H123Y_S146R_D147Y_E155V_I156F), (H36L_P48L_L84F_A106V_D108N_H123Y_E134G_D147Y_E155V_I156F), (H36L_L84F_A106V_D108N_H123Y_D147Y_E155V_I156F_K157N), (H36L_L84F_A106V_D108N_H123Y_S146C_D147Y_E155V_I156F), (L84F_A106V_D108N_H123Y_S146R_D147Y_E155V_I156F_K161T), (N37S_R51H_D77G_L84F_A106V_D108N_H123Y_D147Y_E155V_I156F), (R51L_L84F_A106V_D108N_H123Y_D147Y_E155V_I156F_K157N), (D24G_Q71R_L84F_H96L_A106V_D108N_H123Y_D147Y_E155V_I156F_K160E), (H36L_G67V_L84F_A106V_D108N_H123Y_S146T_D147Y_E155V_I156F), (Q71L_L84F_A106V_D108N_H123Y_L137M_A143E_D147Y_E155V_I156F), (E25G_L84F_A106V_D108N_H123Y_D147Y_E155V_I156F_Q159L), (L84F_A91T_F104I_A106V_D108N_H123Y_D147Y_E155V_I156F), (N72D_L84F_A106V_D108N_H123Y_G125A_D147Y_E155V_I156F), (P48S_L84F_S97C_A106V_D108N_H123Y_D147Y_E155V_I156F), (W23G_L84F_A106V_D108N_H123Y_D147Y_E155V_I156F), (D24G_P48L_Q71R_L84F_A106V_D108N_H123Y_D147Y_E155V_I156F_Q159L), (L84F_A106V_D108N_H123Y_A142N_D147Y_E155V_I156F), (H36L_R51L_L84F_A106V_D108N_H123Y_A142N_S146C_D147Y_E155V_I156F_K157N), (N37S_L84F_A106V_D108N_H123Y_A142N_D147Y_E155V_I156F_K161T), (L84F_A106V_D108N_D147Y_E155V_I156F), (R51L_L84F_A106V_D108N_H123Y_S146C_D147Y_E155V_I156F_K157N_K161T), (L84F_A106V_D108N_H123Y_S146C_D147Y_E155V_I156F_K161T), (L84F_A106V_D108N_H123Y_S146C_D147Y_E155V_I156F_K157N_K160E_K161T), (L84F_A106V_D108N_H123Y_S146C_D147Y_E155V_I156F_K157N_K160E), (R74Q L84F_A106V_D108N_H123Y_D147Y_E155V_I156F), (R74A_L84F_A106V_D108N_H123Y_D147Y_E155V_I156F), (L84F_A106V_D108N_H123Y_D147Y_E155V_I156F), (R74Q_L84F_A106V_D108N_H123Y_D147Y_E155V_I156F), (L84F_R98Q_A106V_D108N_H123Y_D147Y_E155V_I156F), (L84F_A106V_D108N_H123Y_R129Q_D147Y_E155V_I156F), (P48S_L84F_A106V_D108N_H123Y_A142N_D147Y_E155V_I156F), (P48S_A142N), (P48T_I49V_L84F_A106V_D108N_H123Y_A142N_D147Y_E155V_I156F_L157N), (P48T_I49V_A142N), (H36L_P48S_R51L_L84F_A106V_D108N_H123Y_S146C_D147Y_E155V_I156F_K157N), (H36L_P48S_R51L_L84F_A106V_D108N_H123Y_S146C_A142N_D147Y_E155V_I156F_K157N), (H36L_P48T_I49V_R51L_L84F_A106V_D108N_H123Y_S146C_D147Y_E155V_I156F_K157N), (H36L_P48T_I49V_R51L_L84F_A106V_D108N_H123Y_A142N_S146C_D147Y_E155V_I156F_K157N), (H36L_P48A_R51L_L84F_A106V_D108N_H123Y_S146C_D147Y_E155V_I156F_K157N), (H36L_P48A_R51L_L84F_A106V_D108N_H123Y_
A142N_S146C_D147Y_E155V_I156F_K157N),
(H36L_P48A_R51L_L84F_A106V_D108N_H123Y_
S146C_A142N_D147Y_E155V_I156F_K157N),
(W23H_H36L_P48A_R51L_L84F_A106V_D108N_
H123Y_S146C_D147Y_E155V_I156F_K157N),
(W23R_H36L_P48A_R51L_L84F_A106V_D108N_
H123Y_S146C_D147Y_E155V_I156F_K157N),
(W23L_H36L_P48A_R51L_L84F_A106V_D108N_
H123Y_S146R_D147Y_E155V_I156F_K161T),
(H36L_P48A_R51L_L84F_A106V_D108N_H123Y_
S146C_D147Y_R152H_E155V_I156F_K157N),
(H36L_P48A_R51L_L84F_A106V_D108N_H123Y_
S146C_D147Y_R152P_E155V_I156F_K157N),
(W23L_H36L_P48A_R51L_L84F_A106V_D108N_
H123Y_S146C_D147Y_R152P_E155V_I156F_K157N),
(W23L_H36L_P48A_R51L_L84F_A106V_D108N_
H123Y_A142A_S146C_D147Y_E155V_I156F_K157N),
(W23L_H36L_P48A_R51L_L84F_A106V_D108N_
H123Y_A142A_S146C_D147Y_R152P_E155V_I156F_
K157N), (W23L_H36L_P48A_R51L_L84F_
A106V_D108N_H123Y_S146R_D147Y_E155V_I156F_
K161T), (W23R_H36L_P48A_R51L_L84F_A106V_
D108N_H123Y_S146C_D147Y_R152P_E155V_I156F_
K157N),
(H36L_P48A_R51L_L84F_A106V_D108N_H123Y_
A142N_S146C_D147Y_R152P_E155V_I156F_K157N).

In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 1, 64-84, 420-437, 672-684, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NOs: 1, 64-84, 420-437, 672-684, or any of the adenosine deaminases provided herein. In some embodiments, the adenosine deaminase comprises the amino acid sequence of any one of SEQ ID NOs: 1, 64-84, 420-437, 672-684, or any of the adenosine deaminases provided herein. In some embodiments, the adenosine deaminase consists of the amino acid sequence of any one of SEQ ID NOs: 1, 64-84, 420-437, 672-684, or any of the adenosine deaminases provided herein. The ecTadA sequences provided below are from ecTadA (SEQ ID NO: 1), absent the N-terminal methionine (M). The saTadA sequences provided below are from saTadA (SEQ DI NO: 8), absent the N-terminal methionine (M). For clarity, the amino acid numbering scheme used to identify the various amino acid mutations is derived from ecTadA (SEQ ID NO: 1) for *E. coli* TadA and saTadA (SEQ ID NO: 8) for *S. aureus* TadA. Amino acid mutations, relative to SEQ ID NO: 1 (ecTadA) or SEQ DI NO: 8 (saTadA), are indicated by underlining.

```
ecTadA
                                                            (SEQ ID NO: 64)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECAALLSDFFRMRRQEIK

AQKKAQSSTD ecTadA (D108N)
                                                            (SEQ ID NO: 65)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARNAKTGAAGSLMDVLHHPGMNHRVEITEGILADECAALLSDFFRMRRQEIK

AQKKAQSSTD ecTadA (D108G)
                                                            (SEQ ID NO: 66)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARGAKTGAAGSLMDVLHHPGMNHRVEITEGILADECAALLSDFFRMRRQEIK

AQKKAQSSTD ecTadA (D108V)
                                                            (SEQ ID NO: 67)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARVAKTGAAGSLMDVLHHPGMNHRVEITEGILADECAALLSDFFRMRRQEIK

AQKKAQSSTD ecTadA (H8Y, D108N, and N127S)
                                                            (SEQ ID NO: 68)
SEVEFSYEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARNAKTGAAGSLMDVLHHPGMSHRVEITEGILADECAALLSDFFRMRRQEIK

AQKKAQSSTD
``` ecTadA (H8Y, D108N, N127S, and E155D)
(SEQ ID NO: 69)
SEVEFSYEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARNAKTGAAGSLMDVLHHPGMSHRVEITEGILADECAALLSDFFRMRRQDIK

AQKKAQSSTD ecTadA (H8Y, D108N, N127S, and E155G)
(SEQ ID NO: 70)
SEVEFSYEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARNAKTGAAGSLMDVLHHPGMSHRVEITEGILADECAALLSDFFRMRRQGIK

AQKKAQSSTD ecTadA (H8Y, D108N, N127S, and E155V)
(SEQ ID NO: 71)
SEVEFSYEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARNAKTGAAGSLMDVLHHPGMSHRVEITEGILADECAALLSDFFRMRRQVIK

AQKKAQSSTD ecTadA (A106V, D108N, D147Y, and E155V)
(SEQ ID NO: 72)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGVRNAKTGAAGSLMDVLHHPGMNHRVEITEGILADECAALLSYFFRMRRQVIK

AQKKAQSSTD ecTadA (L84F, A106V, D108N, H123Y, D147Y, E155V, I156F)-result of evolution #3
(SEQ ID NO: 73)
SEVEFSHEYWMRHALTLAKRAWDEREVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECAALLSYFFRMRRQVFK

AQKKAQSSTD ecTadA (S2A, I49F, A106V, D108N, D147Y, E155V)-result of evolution #3
(SEQ ID NO: 74)
AEVEFSHEYWMRHALTLAKRAWDEREVPVGAVLVHNNRVIGEGWNRPFGRHDPTAHAEIMALRQGGLVMQNYRLIDAT

LYVTLEPCVMCAGAMIHSRIGRVVFGVRNAKTGAAGSLMDVLHHPGMNHRVEITEGILADECAALLSYFFRMRRQVIK

AQKKAQSSTD ecTadA (H8Y, A106T, D108N, N127S, K160S)-result of evolution #3
(SEQ ID NO: 75)
SEVEFSYEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGTRNAKTGAAGSLMDVLHHPGMSHRVEITEGILADECAALLSDFFRMRRQEIK

AQSKAQSSTD ecTadA (R26G, L84F, A106V, R107H, D108N, H123Y, A142N, A143D, D147Y, E155V, I156F)-result of evolution #4
(SEQ ID NO: 76)
SEVEFSHEYWMRHALTLAKRAWDEGEVPVGAVLVHNNRVIGEGWNRPIGRHDPTAHAEIMALRQGGLVMQNYRLIDAT

LYVTFEPCVMCAGAMIHSRIGRVVFGVHNAKTGAAGSLMDVLHYPGMNHRVEITEGILADECNDLLSYFFRMRRQVFK

AQKKAQSSTD ecTadA (E25G, R26G, L84F, A106V, R107H, D108N, H123Y, A142N, A143D, D147Y, E155V, I156F)-result of evolution #4
(SEQ ID NO: 77)
SEVEFSHEYWMRHALTLAKRAWDGGEVPVGAVLVHNNRVIGEGWNRPIGRHDPTAHAEIMALRQGGLVMQNYRLIDAT

LYVTFEPCVMCAGAMIHSRIGRVVFGVHNAKTGAAGSLMDVLHYPGMNHRVEITEGILADECNDLLSYFFRMRRQVFK

AQKKAQSSTD

-continued ecTadA (E25D, R26G, L84F, A106V, R107K, D108N, H123Y, A142N, A143G, D147Y, E155V, I156F)-result of evolution #4

(SEQ ID NO: 78)

SEVEFSHEYWMRHALTLAKRAWDDGEVPVGAVLVHNNRVIGEGWNRPIGRHDPTAHAEIMALRQGGLVMQNYRLIDAT

LYVTFEPCVMCAGAMIHSRIGRVVFGVKNAKTGAAGSLMDVLHYPGMNHRVEITEGILADECNGLLSYFFRMRRQVFK

AQKKAQSSTD ecTadA (R26Q, L84F, A106V, D108N, H123Y, A142N, D147Y, E155V, I156F)-result of evolution #4

(SEQ ID NO: 79)

SEVEFSHEYWMRHALTLAKRAWDEQEVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECNALLSYFFRMRRQVFK

AQKKAQSSTD ecTadA (E25M, R26G, L84F, A106V, R107P, D108N, H123Y, A142N, A143D, D147Y, E155V, I156F)-result of evolution #4

(SEQ ID NO: 80)

SEVEFSHEYWMRHALTLAKRAWDMGEVPVGAVLVHNNRVIGEGWNRPIGRHDPTAHAEIMALRQGGLVMQNYRLIDAT

LYVTFEPCVMCAGAMIHSRIGRVVFGVPNAKTGAAGSLMDVLHYPGMNHRVEITEGILADECNDLLSYFFRMRRQVFK

AQKKAQSSTD ecTadA (R26C, L84F, A106V, R107H, D108N, H123Y, A142N , D147Y, E155V, I156F)-result of evolution #4

(SEQ ID NO: 81)

SEVEFSHEYWMRHALTLAKRAWDECEVPVGAVLVHNNRVIGEGWNRPIGRHDPTAHAEIMALRQGGLVMQNYRLIDAT

LYVTFEPCVMCAGAMIHSRIGRVVFGVHNAKTGAAGSLMDVLHYPGMNHRVEITEGILADECNALLSYFFRMRRQVFK

AQKKAQSSTD ecTadA (L84F, A106V, D108N, H123Y, A142N, A143L, D147Y, E155V, I156F)-result of evolution #4

(SEQ ID NO: 82)

SEVEFSHEYWMRHALTLAKRAWDEREVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECNLLLSYFFRMRRQVFK

AQKKAQSSTD ecTadA (R26G, L84F, A106V, D108N, H123Y, A142N , D147Y, E155V, I156F)-result of evolution #4

(SEQ ID NO: 83)

SEVEFSHEYWMRHALTLAKRAWDEGEVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECNALLSYFFRMRRQVFK

AQKKAQSSTD ecTadA (E25A, R26G, L84F, A106V, R107N, D108N, H123Y, A142N, A143E, D147Y, E155V, I156F)-result of evolution #4

(SEQ ID NO: 420)

SEVEFSHEYWMRHALTLAKRAWDAGEVPVGAVLVHNNRVIGEGWNRPIGRHDPTAHAEIMALRQGGLVMQNYRLIDAT

LYVTFEPCVMCAGAMIHSRIGRVVFGVNNAKTGAAGSLMDVLHYPGMNHRVEITEGILADECNELLSYFFRMRRQVFK

AQKKAQSSTD ecTadA (L84F, A106V, D108N, H123Y, D147Y, E155V, I156F)-mutations from evolution #'s 1-3

(SEQ ID NO: 421)

SEVEFSHEYWMRHALTLAKRAWDEREVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECAALLSYFFRMRRQVFK

AQKKAQSSTD ecTadA (N37T, P48T, L84F, A106V, D108N, H123Y, D147Y, E155V, I156F)-mutations from evolution # 5-1

(SEQ ID NO: 422)

SEVEFSHEYWMRHALTLAKRAWDEREVPVGAVLVHTNRVIGEGWNRTIGRHDPTAHAEIMALRQGGLVMQNYRLIDAT

LYVTFEPCVMCAGAMIHSRIGRVVFGVRNAKTGAAGSLMDVLHYPGMNHRVEITEGILADECAALLSYFFRMRRQVFK

AQKKAQSSTD

-continued ecTadA (N37S, L84F, A106V, D108N, H123Y, D147Y, E155V, I156F)-mutations from evolution # 5-2
(SEQ ID NO: 423)
SEVEFSHEYWMRHALTLAKRAWDEREVPVGAVLVH<u>S</u>NRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>K

AQKKAQSSTD ecTadA (H36L, L84F, A106V, D108N, H123Y, D147Y, E155V, I156F)-mutations from evolution # 5-3
(SEQ ID NO: 424)
SEVEFSHEYWMRHALTLAKRAWDEREVPVGAVLVL<u>N</u>NRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>K

AQKKAQSSTD ecTadA (L84F, A106V, D108N, H123Y, S146R, D147Y, E155V, I156F)-mutations from evolution # 5-4
(SEQ ID NO: 425)
SEVEFSHEYWMRHALTLAKRAWDEREVPVGAVLVHNNRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALL<u>R</u>YFFRMRRQ<u>VF</u>K

AQKKAQSSTD ecTadA (H36L, P48L, L84F, A106V, D108N, H123Y, D147Y, E155V, I156F)-mutations from evolution # 5-5
(SEQ ID NO: 426)
SEVEFSHEYWMRHALTLAKRAWDEREVPVGAVLV<u>L</u>NNRVIGEGWNR<u>L</u>IGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>K

AQKKAQSSTD ecTadA (H36L, L84F, A106V, D108N, H123Y, D147Y, E155V, K57N, I156F)-mutations from evolution # 5-6
(SEQ ID NO: 427)
SEVEFSHEYWMRHALTLAKRAWDEREVPVGAVLV<u>L</u>NNRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>N

AQKKAQSSTD ecTadA (H36L, L84F, A106V, D108N, H123Y, S146C, D147Y, E155V, I156F)-mutations from evolution # 5-7
(SEQ ID NO: 428)
SEVEFSHEYWMRHALTLAKRAWDEREVPVGAVLV<u>L</u>NNRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALL<u>C</u>YFFRMRRQ<u>VF</u>K

AQKKAQSSTD ecTadA (L84F, A106V, D108N, H123Y, S146R, D147Y, E155V, I156F)-mutations from evolution # 5-8
(SEQ ID NO: 429)
SEVEFSHEYWMRHALTLAKRAWDEREVPVGAVLVHNNRVIGEGWNRPIGRHDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALL<u>R</u>YFFRMRRQ<u>VF</u>K

AQKKAQSSTD ecTadA (N37S, R51H, L84F, A106V, D108N, H123Y, D147Y, E155V, I156F)-mutations from evolution # 5-9
(SEQ ID NO: 430)
SEVEFSHEYWMRHALTLAKRAWDEREVPVGAVLVH<u>S</u>NRVIGEGWNRPIG<u>H</u>HDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>K

AQKKAQSSTD ecTadA (R51L, L84F, A106V, D108N, H123Y, D147Y, E155V, I156F, K157N)-mutations from evolution # 5-10
(SEQ ID NO: 431)
SEVEFSHEYWMRHALTLAKRAWDEREVPVGAVLVHNNRVIGEGWNRPIG<u>L</u>HDPTAHAEIMALRQGGLVMQNYRLIDAT LYVT<u>F</u>EPCVMCAGAMIHSRIGRVVFG<u>VR</u>NAKTGAAGSLMDVLH<u>Y</u>PGMNHRVEITEGILADECAALLS<u>Y</u>FFRMRRQ<u>VF</u>N

AQKKAQSSTD ecTadA (R51H, L84F, A106V, D108N, H123Y, D147Y, E155V, I156F, K157N)-mutations from evolution # 5-11

(SEQ ID NO: 432)
SEVEFSHEYWMRHALTLAKRAWDEREVPVGAVLVHNNRVIGEGWNRPIGHHDPTAHAEIMALRQGGLVMQNYRLIDAT
LYVTFEPCVMCAGAMIHSRIGRVVFGVRNAKTGAAGSLMDVLHYPGMNHRVEITEGILADECAALLSYFFRMRRQVFN
AQKKAQSSTD saTadA (wt)-as used in pNMG-345:

(SEQ ID NO: 8)
MGSHMTNDIYFMTLAIEEAKKAAQLGEVPIGAIITKDDEVIARAHNLRETLQQPTAHAEHIAIERAAKVLGSWRLEGC
TLYVTLEPCVMCAGTIVMSRIPRVVYGADDPKGGCSGSLMNLLQQSNFNHRAIVDKGVLKEACSTLLTTFFKNLRANK
KSTN saTadA (D108N)-as used in pNMG-346:

(SEQ ID NO: 433)
GSHMTNDIYFMTLAIEEAKKAAQLGEVPIGAIITKDDEVIARAHNLRETLQQPTAHAEHIAIERAAKVLGSWRLEGCT
LYVTLEPCVMCAGTIVMSRIPRVVYGADNPKGGCSGSLMNLLQQSNFNHRAIVDKGVLKEACSTLLTTFFKNLRANKK
STN saTadA (D107A_D108N)-as used in pNMG-347:

(SEQ ID NO: 434)
GSHMTNDIYFMTLAIEEAKKAAQLGEVPIGAIITKDDEVIARAHNLRETLQQPTAHAEHIAIERAAKVLGSWRLEGCT
LYVTLEPCVMCAGTIVMSRIPRVVYGAANPKGGCSGSLMNLLQQSNFNHRAIVDKGVLKEACSTLLTTFFKNLRANKK
STN saTadA (G26P_D107A_D108N)-as used in pNMG-348:

(SEQ ID NO: 435)
GSHMTNDIYFMTLAIEEAKKAAQLPEVPIGAIITKDDEVIARAHNLRETLQQPTAHAEHIAIERAAKVLGSWRLEGCT
LYVTLEPCVMCAGTIVMSRIPRVVYGAANPKGGCSGSLMNLLQQSNFNHRAIVDKGVLKEACSTLLTTFFKNLRANKK
STN saTadA (G26P_D107A_D108N_S142A)-as used in pNMG-349:

(SEQ ID NO: 436)
GSHMTNDIYFMTLAIEEAKKAAQLPEVPIGAIITKDDEVIARAHNLRETLQQPTAHAEHIAIERAAKVLGSWRLEGCT
LYVTLEPCVMCAGTIVMSRIPRVVYGAANPKGGCSGSLMNLLQQSNFNHRAIVDKGVLKEACATLLTTFFKNLRANKK
STN saTadA (D107A_D108N_S142A)-as used in pNMG-350:

(SEQ ID NO: 437)
GSHMTNDIYFMTLAIEEAKKAAQLGEVPIGAIITKDDEVIARAHNLRETLQQPTAHAEHIAIERAAKVLGSWRLEGCT
LYVTLEPCVMCAGTIVMSRIPRVVYGAANPKGGCSGSLMNLLQQSNFNHRAIVDKGVLKEACATLLTTFFKNLRANKK
STN ecTadA (P48S)-mutation from evolution #6

(SEQ ID NO: 672)
SEVEFSHEYWMRHALTLAKRAWDEREVPVGAVLVHNNRVIGEGWNRSIGRHDPTAHAEIMALRQGGLVMQNYRLIDAT
LYVTLEPCVMCAGAMIHSRIGRVVFGARDAKTGAAGSLMDVLHHPGMNHRVEITEGILADECAALLSDFFRMRRQEIK
AQKKAQSSTD ecTadA (P48T)-mutation from evolution #6

(SEQ ID NO: 673)
SEVEFSHEYWMRHALTLAKRAWDEREVPVGAVLVHNNRVIGEGWNRTIGRHDPTAHAEIMALRQGGLVMQNYRLIDAT
LYVTLEPCVMCAGAMIHSRIGRVVFGARDAKTGAAGSLMDVLHHPGMNHRVEITEGILADECAALLSDFFRMRRQEIK
AQKKAQSSTD ecTadA (P48A)-mutation from evolution #6

(SEQ ID NO: 674)
SEVEFSHEYWMRHALTLAKRAWDEREVPVGAVLVHNNRVIGEGWNRAIGRHDPTAHAEIMALRQGGLVMQNYRLIDAT
LYVTLEPCVMCAGAMIHSRIGRVVFGARDAKTGAAGSLMDVLHHPGMNHRVEITEGILADECAALLSDFFRMRRQEIK
AQKKAQSSTD ecTadA (A142N)-mutation from evolution #6
(SEQ ID NO: 675)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECNALLSDFFRMRRQEIK

AQKKAQSSTD ecTadA (W23R)-mutation from evolution #7
(SEQ ID NO: 676)
SEVEFSHEYWMRHALTLAKRARDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECAALLSDFFRMRRQEIK

AQKKAQSSTD ecTadA (W23L)-mutation from evolution #7
(SEQ ID NO: 677)
SEVEFSHEYWMRHALTLAKRALDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECAALLSDFFRMRRQEIK

AQKKAQSSTD ecTadA (R152P)-mutation from evolution #7
(SEQ ID NO: 678)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECAALLSDFFRMPRQEIK

AQKKAQSSTD ecTadA (R152H)-mutation from evolution #7
(SEQ ID NO: 679)
SEVEFSHEYWMRHALTLAKRAWDEREVPVGAVLVHNNRVIGEGWNRPIGRHDPTAHAEIMALRQGGLVMQNYRLIDAT

LYVTLEPCVMCAGAMIHSRIGRVVFGARDAKTGAAGSLMDVLHHPGMNHRVEITEGILADECAALLSDFFRMHRQEIK

AQKKAQSSTD ecTadA (L84F, A106V, D108N, H123Y, D147Y, E155V, I156F)-mutations from
pNMG 371
(SEQ ID NO: 680)
SEVEFSHEYWMRHALTLAKRAWDEREVPVGAVLVHNNRVIGEGWNRPIGRHDPTAHAEIMALRQGGLVMQNYRLIDAT

LYVTFEPCVMCAGAMIHSRIGRVVFGVRNAKTGAAGSLMDVLHYPGMNHRVEITEGILADECAALLSYFFRMRRQVFK

AQKKAQSSTD ecTadA (H36L, R51L, L84F, A106V, D108N, H123Y, S146C, D147Y, E155V, I156F,
K157N)-mutations from pNMG 477
(SEQ ID NO: 681)
SEVEFSHEYWMRHALTLAKRAWDEREVPVGAVLVLNNRVIGEGWNRPIGLHDPTAHAEIMALRQGGLVMQNYRLIDAT

LYVTFEPCVMCAGAMIHSRIGRVVFGVRNAKTGAAGSLMDVLHYPGMNHRVEITEGILADECAALLCYFFRMRRQVFN

AQKKAQSSTD ecTadA (H36L, P48S, R51L, L84F, A106V, D108N, H123Y, S146C, D147Y, E155V,
I156F, K157N)-mutations from pNMG 576
(SEQ ID NO: 682)
SEVEFSHEYWMRHALTLAKRAWDEREVPVGAVLVLNNRVIGEGWNRSIGLHDPTAHAEIMALRQGGLVMQNYRLIDAT

LYVTFEPCVMCAGAMIHSRIGRVVFGVRNAKTGAAGSLMDVLHYPGMNHRVEITEGILADECAALLCYFFRMRRQVFN

AQKKAQSSTD ecTadA (H36L, P48A, R51L, L84F, A106V, D108N, H123Y, S146C, D147Y, E155V,
I156F, K157N)-mutations from pNMG 586
(SEQ ID NO: 683)
SEVEFSHEYWMRHALTLAKRAWDEREVPVGAVLVLNNRVIGEGWNRAIGLHDPTAHAEIMALRQGGLVMQNYRLIDAT

LYVTFEPCVMCAGAMIHSRIGRVVFGVRNAKTGAAGSLMDVLHYPGMNHRVEITEGILADECAALLCYFFRMRRQVFN

AQKKAQSSTD

-continued ecTadA (W23L, H36L, P48A, R51L, L84F, A106V, D108N, H123Y, S146C, D147Y, R152P, E155V, I156F, K157N)-mutations from pNMG 616

(SEQ ID NO: 684)

SEVEFSHEYWMRHALTLAKRALDEREVPVGAVLVLNNRVIGEGWNRAIGLHDPTAHAEIMALRQGGLVMQNYRLIDAT

LYVTFEPCVMCAGAMIHSRIGRVVFGVRNAKTGAAGSLMDVLHYPGMNHRVEITEGILADECAALLCYFFRMPRQVFN

AQKKAQSSTD

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 108-357. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 108-357. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 52, or a corresponding mutation in any of the amino acid sequences provided in SEQ ID NOs: 108-357, wherein X is any amino acid change. In some embodiments, the nuclease-inactive dCas9 domain comprises a D10A mutation and a H840A mutation of the amino acid sequence set forth in SEQ ID NO: 52, or a corresponding mutation in any of the amino acid sequences provided in SEQ ID NOs: 108-357. As one example, a nuclease-inactive Cas9 domain comprises the amino acid sequence set forth in SEQ ID NO: 54 (Cloning vector pPlatTET-gRNA2, Accession No. BAV54124).

(SEQ ID NO: 54)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

-continued
LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD;

see, e.g., Qi et al., "Repurposing CRISPR as an RNA-guided platform for sequence-specific control of gene expression." Cell. 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. Nature Biotechnology. 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 52, or a mutation in any of SEQ ID NOs: 108-357. As one example, a Cas9 nickase may comprise the amino acid sequence as set forth in SEQ ID NO: 35. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 52, or a corresponding mutation in any of SEQ ID NOs: 108-357. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 55. In some embodiments, the SaCas9 comprises a N579X mutation of SEQ ID NO: 55, or a corresponding mutation in any of the amino acid sequences provided in SEQ ID NOs: 108-357, wherein X is any amino acid except for N. In some embodiments, the SaCas9 comprises a N579A mutation of SEQ ID NO: 55, or a corresponding mutation in any of the amino acid sequences provided in SEQ ID NOs: 108-357.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X mutation of SEQ ID NO: 55, or a corresponding mutation in any of the amino acid sequences provided in SEQ ID NOs: 108-357, wherein X is any amino acid. In some embodiments, the SaCas9 domain comprises one or more of a E781K, a N967K, and a R1014H mutation of SEQ ID NO: 55, or one or more corresponding mutation in any of the amino acid sequences provided in SEQ ID NOs: 108-357. In some embodiments, the SaCas9 domain comprises a E781K, a N967K, or a R1014H mutation of SEQ ID NO: 55, or corresponding mutations in any of the amino acid sequences provided in SEQ ID NOs: 108-357.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 55-57. In some embodiments, the Cas9 domain of any of the fusion proteins provided herein comprises the amino acid sequence of any one of SEQ ID NOs: 55-57. In some embodiments, the Cas9 domain of any of the fusion proteins provided herein consists of the amino acid sequence of any one of SEQ ID NOs: 55-57.

Exemplary SaCas9 sequence (SEQ ID NO: 55)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG

Residue N579 of SEQ ID NO: 55, which is underlined and in bold, may be mutated (e.g., to a A579) to yield a SaCas9 nickase.

Exemplary SaCas9n sequence (SEQ ID NO: 56)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG.

Residue A579 of SEQ ID NO: 56, which can be mutated from N579 of SEQ ID NO: 55 to yield a SaCas9 nickase, is underlined and in bold.

Exemplary SaKKH Cas9

(SEQ ID NO: 57)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERIANRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNR*K*LINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFY*K*NDLIKINGELYRVIGVNNDLLNRIEVNMIDITY

REYLENMNDKRPP*H*IIKTIASKTQSIKKYSTDILGNLYEVKSKKHPQIIK

KG.

Residue A579 of SEQ ID NO: 57, which can be mutated from N579 of SEQ ID NO: 55 to yield a SaCas9 nickase, is underlined and in bold. Residues K781, K967, and H1014 of SEQ ID NO: 57, which can be mutated from E781, N967, and R1014 of SEQ ID NO: 55 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 58. In some embodiments, the SpCas9 comprises a D9X mutation of SEQ ID NO: 58, or a corresponding mutation in any of the amino acid sequences provided in SEQ ID NOs: 108-357, wherein X is any amino acid except for D. In some embodiments, the SpCas9 comprises a D9A mutation of SEQ ID NO: 58, or a corresponding mutation in any of the amino acid sequences provided in SEQ ID NOs: 108-357. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134E, R1334Q, and T1336R mutation of SEQ ID NO: 58, or a corresponding mutation in any of the amino acid sequences provided in SEQ ID NOs: 108-35. In some embodiments, the SpCas9 domain comprises a D1134E, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a G1217X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a G1217R, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a G1217R, a R1334Q, and a T1336R mutation of SEQ ID NO: 58, or corresponding mutations in any of the amino acid sequences provided in SEQ ID NOs: 108-35.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 58-62. In some embodiments, the Cas9 domain of any of the fusion proteins provided herein comprises the amino acid sequence of any one of SEQ ID NOs: 58-62. In some embodiments, the Cas9 domain of any of the fusion proteins provided herein consists of the amino acid sequence of any one of SEQ ID NOs: 58-62.

Exemplary SpCas9
(SEQ ID NO: 58)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n
(SEQ ID NO: 59)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

```
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD
```

Exemplary SpEQR Cas9
(SEQ ID NO: 60)
```
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFESPTVAYSVLVVAKVEK
GKSKKLKSVKELLGITIMERSSFEKNPIDFLEAKGYKEVKKDLIIKLPKYS
LFELENGRKRMLASAGELQKGNELALPSKYVNFLYLASHYELKLGSPEDN
EQKQLFVEQHKHYLDEIIEQISEFSKRVILADANLDKVLSAYNKHRDKPI
REQAENIIHLFTLTNLGAPAAFKYFDTTIDRKQYRSTKEVLDATLIHQSI
TGLYETRIDLSQLGGD
```

Residues E1134, Q1334, and R1336 of SEQ ID NO: 60, which can be mutated from D1134, R1334, and T1336 of SEQ ID NO: 58 to yield a SpEQR Cas9, are underlined and in bold.

Exemplary SpVQR Cas9
(SEQ ID NO: 61)
```
DKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFH
RLEESFLVEEDKKHERHPIFGNIVDEVAYHEKYPTIYHLRKKLVDSTDK
ADLRLIYLALAHMIKFRGHFLIEGDLNPDNSDVDKLFIQLVQTYNQLFE
ENPINASGVDAKAILSARLSKSRRLENLIAQLPGEKKNGLFGNLIALSL
GLTPNFKSNFDLAEDAKLQLSKDTYDDDLDNLLAQIGDQYADLFLAAKN
LSDAILLSDILRVNTEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNA
SLGTYHDLLKIIKDKDFLDNEENEDILEDIVLTLTLFEDREMIEERLKT
YAHLFDDKVMKQLKRRRYTGWGRLSRKLINGIRDKQSGKTILDFLKSDG
FANRNFMQLIHDDSLTFKEDIQKAQVSGQGDSLHEHIANLAGSPAIKKG
ILQTVKVVDELVKVMGRHKPENIVIEMARENQTTQKGQKNSRERMKRIE
EGIKELGSQILKEHPVENTQLQNEKLYLYYLQNGRDMYVDQELDINRLS
DYDVDHIVPQSFLKDDSIDNKVLTRSDKNRGKSDNVPSEEVVKKMKNYW
RQLLNAKLITQRKFDNLTKAERGGLSELDKAGFIKRQLVETRQITKHVA
QILDSRMNTKYDENDKLIREVKVITLKSKLVSDFRKDFQFYKVREINNY
HHAHDAYLNAVVGTALIKKYPKLESEFVYGDYKVYDVRKMIAKSEQEIG
KATAKYFFYSNIMNFFKTEITLANGEIRKRPLIETNGETGEIVWDKGRD
FATVRKVLSMPQVNIVKKTEVQTGGFSKESILPKRNSDKLIARKKDWDP
KKYGGFVSPTVAYSVLVVAKVEKGKSKKLKSVKELLGITIMERSSFEKN
PIDFLEAKGYKEVKKDLIIKLPKYSLFELENGRKRMLASAGELQKGNEL
ALPSKYVNFLYLASHYEKLKGSPEDNEQKQLFVEQHKHYLDEIIEQISE
FSKRVILADANLDKVLSAYNKHRDKPIREQAENIIHLFTLTNLGAPAAF
KYFDTTIDRKQYRSTKEVLDATLIHQSITGLYETRIDLSQLGGD
```

Residues V1134, Q1334, and R1336 of SEQ ID NO: 61, which can be mutated from D1134, R1334, and T1336 of SEQ ID NO: 58 to yield a SpVQR Cas9, are underlined and in bold.

Exemplary SpVRER Cas9
(SEQ ID NO: 62)
DKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDHIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFVSPTVAYSVLVVAKVEKGKSKKLKSVKELLGITIMERSSFEKN

PIDFLEAKGYKEVKKDLIIKLPKYSLFELENGRKRMLASARELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKEYRSTKEVLDATLIHQSITGLYETRIDLSQLGGD

Residues V1134, R1217, Q1334, and R1336 of SEQ ID NO: 62, which can be mutated from D1134, G1217, R1334, and T1336 of SEQ ID NO: 58 to yield a SpVRER Cas9, are underlined and in bold.

High Fidelity Cas9 Domains

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain (e.g., a wild type Cas9 domain) comprises one or more mutations that decreases the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, any of the Cas9 fusion proteins provided herein comprise one or more of N497X, R661X, Q695X, and/or Q926X mutation of the amino acid sequence provided in SEQ ID NO: 52, or a corresponding mutation in any of the amino acid sequences provided in SEQ ID NOs: 108-357, wherein X is any amino acid. In some embodiments, any of the Cas9 fusion proteins provided herein comprise one or more of N497A, R661A, Q695A, and/or Q926A mutation of the amino acid sequence provided in SEQ ID NO: 52, or a corresponding mutation in any of the amino acid sequences provided in SEQ ID NOs: 108-357. In some embodiments, the Cas9 domain comprises a D10A mutation of the amino acid sequence provided in SEQ ID NO: 52, or a corresponding mutation in any of the amino acid sequences provided in SEQ ID NOs: 108-357. In some embodiments, the Cas9 domain (e.g., of any of the fusion proteins provided herein) comprises the amino acid sequence as set forth in SEQ ID NO: 62. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that any of the base editors provided herein, for example, any of the adenosine deaminase base editors provided herein, may be converted into high fidelity base editors by modifying the Cas9 domain as described herein to generate high fidelity base editors, for example, a high fidelity adenosine base editor. In some embodiments, the high fidelity Cas9 domain is a dCas9 domain. In some embodiments, the high fidelity Cas9 domain is a nCas9 domain.

High Fidelity Cas9 Domain where Mutations Relative to Cas9 of SEQ ID NO: 10 are Shown in Bold and Underlines (SEQ ID NO: 63)
DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSF

FHRLEESFLVEEDKKHERHPIFGNIVDEVAYHEKYPTIYHLRKKLVDS

TDKADLRLIYLALAHMIKFRGHFLIEGDLNPDNSDVDKLFIQLVQTYN

QLFEENPINASGVDAKAILSARLSKSRRLENLIAQLPGEKKNGLFGNL

IALSLGLTPNFKSNFDLAEDAKLQLSKDTYDDDLDNLLAQIGDQYADL

FLAAKNLSDAILLSDILRVNTEITKAPLSASMIKRYDEHHQDLTLLKA

LVRQQLPEKYKEIFFDQSKNGYAGYIDGGASQEEFYKFIKPILEKMDG

TEELLVKLNREDLLRKQRTFDNGSIPHQIHLGELHAILRRQEDFYPFL

KDNREKIEKILTFRIPYYVGPLARGNSRFAWMTRKSEETITPWNFEEV

VDKGASAQSFIERMTAFDKNLPNEKVLPKHSLLYEYFTVYNELTKVKY

-continued
```
VTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTL

FEDREMIEERLKTYAHLFDDKVMKQLKRRRYTGWGALSRKLINGIRDK

QSGKTILDFLKSDGFANRNFMALIHDDSLTFKEDIQKAQVSGQGDSLH

EHIANLAGSPAIKKGILQTVKVVDELVKVMGRHKPENIVIEMARENQT

TQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRG

KSDNVPSEEVVKKMKNYWRQLLNAKLITQRKFDNLTKAERGGLSELDK

AGFIKRQLVETRAITKHVAQILDSRMNTKYDENDKLIREVKVITLKSK

LVSDFRKDFQFYKVREINNYHHAHDAYLNAVVGTALIKKYPKLESEFV

YGDYKVYDVRKMIAKSEQEIGKATAKYFFYSNIMNFFKTEITLANGEI

RKRPLIETNGETGEIVWDKGRDFATVRKVLSMPQVNIVKKTEVQTGGF

SKESILPKRNSDKLIARKKDWDPKKYGGFDSPTVAYSVLVVAKVEKGK

SKKLKSVKELLGITIMERSSFEKNPIDFLEAKGYKEVKKDLIIKLPKY

SLFELENGRKRMLASAGELQKGNELALPSKYVNFLYLASHYEKLKGSP

EDNEQKQLFVEQHKHYLDEIIEQISEFSKRVILADANLDKVLSAYNKH

RDKPIREQAENIIHLFTLTNLGAPAAFKYFDTTIDRKRYTSTKEVLDA

TLIHQSITGLYETRIDLSQLGGD
```

Nucleic Acid Programmable DNA Binding Proteins

Some aspects of the disclosure provide nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2c1, C2c2, C2C3, and Argonaute. One example of an nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." *Cell* (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 382) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 376. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382, and comprises mutations corresponding to D917A, E1006A, D1255A, D917A/E1006A, D917A/D1255A, E1006A/D1255A, or D917A/E1006A/D1255A in SEQ ID NO: 376. In some embodiments, the dCpf1 comprises an amino acid sequence of any one SEQ ID NOs: 376-382. It should be appreciated that Cpf1 from other bacterial species may also be used in accordance with the present disclosure.

Wild Type *Francisella novicida* Cpf1 (SEQ ID NO: 376) (D917, E1006, and D1255 are Bolded and Underlined)

(SEQ ID NO: 376)
```
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMWDEIAQNKDNLAQ

ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN
```

-continued

LLLKEKANDVHILSIDRGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDADANGAYHIGLKGLMLLGRIKNNQEGKKLNLVIKNEEYFEFVQNRNN

*Francisella novicida* Cpf1 D917A (SEQ ID NO: 377)
(A917, E1006, and D1255 are Bolded and Underlined)

(SEQ ID NO: 377)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMWDEIAQNKDNLAQ

ISIKYQNGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIARGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDADANGAYHIGLKGLMLLGRIKNNQEGKKLNLVIKNEEYFEFVQNRNN

*Francisella novicida* Cpf1 E1006A (SEQ ID NO: 378)
(D917, A1006, and D1255 are Bolded and Underlined)

(SEQ ID NO: 378)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVFDDYSVIGTAVLEYITQQIAPKNLDNPSKKEQELI

AKKTEKAKYLSLETIKLALEEFNKHRDIDKQCRFEEILANFAAIPMWDE

IAQNKDNLAQISIKYQNGKKDLLQASAEDDVKAIKDLLDQTNNLLHKL

KIFHISQSEDKANILDKDEHFYLVFEECYFELANIVPLYNKIRNYITQK

PYSDEKFKLNFENSTLANGWDKNKEPDNTAILFIKDDKYYLGVMNKKNN

KIFDDKAIKENKGEGYKKIVYKLLPGANKMLPKVFFSAKSIKFYNPSED

ILRIRNHSTHTKNGSPQKGYEKFEFNIEDCRKFIDFYKQSISKHPEWKD

FGFRFSDTQRYNSIDEFYREVENQGYKLTFENISESYIDSVVNQGKLYL

FQIYNKDFSAYSKGRPNLHTLYWKALFDERNLQDVVYKLNGEAELFYRK

QSIPKKITHPAKEAIANKNKDNPKKESVFEYDLIKDKRFTEDKFFFHCP

ITINFKSSGANKFNDEINLLLKEKANDVHILSIDRGERHLAYYTLVDGK

GNIIKQDTFNIIGNDRMKTNYHDKLAAIEKDRDSARKDWKKINNIKEMK

EGYLSQVVHEIAKLVIEYNAIVVFADLNFGFKRGRFKVEKQVYQKLEKM

LIEKLNYLVFKDNEFDKTGGVLRAYQLTAPFETFKKMGKQTGIIYYVPA

GFTSKICPVTGFVNQLYPKYESVSKSQEFFSKFDKICYNLDKGYFEFSF

DYKNFGDKAAKGKWTIASFGSRLINFRNSDKNHNWDTREVYPTKELEKL

LKDYSIEYGHGECIKAAICGESDKKFFAKLTSVLNTILQMRNSKTGTEL

DYLISPVADVNGNFFDSRQAPKNMPQDADANGAYHIGLKGLMLLGRIKN

NQEGKKLNLVIKNEEYFEFVQNRNN

*Francisella novicida* Cpf1 D1255A (SEQ ID NO: 379)
(D917, E1006, and A1255 are Bolded and Underlined)

(SEQ ID NO: 379)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMWDEIAQNKDNLAQ

```
ISIKYQNQGKKDLLQASAEDDVKAIKDLLDQTNNLLHKLKIFHISQSEDK

ANILDKDEHFYLVFEECYFELANIVPLYNKIRNYITQKPYSDEKFKLNFE

NSTLANGWDKNKEPDNTAILFIKDDKYYLGVMNKKNNKIFDDKAIKENKG

EGYKKIVYKLLPGANKMLPKVFFSAKSIKFYNPSEDILRIRNHSTHTKNG

SPQKGYEKFEFNIEDCRKFIDFYKQSISKHPEWKDFGFRFSDTQRYNSID

EFYREVENQGYKLTFENISESYIDSVVNQGKLYLFQIYNKDFSAYSKGRP

NLHTLYWKALFDERNLQDVVYKLNGEAELFYRKQSIPKKITHPAKEAIAN

KNKDNPKKESVFEYDLIKDKRFTEDKFFFHCPITINFKSSGANKFNDEIN

LLLKEKANDVHILSIDRGERHLAYYTLVDGKGNIIKQDTFNIIGNDRMKT

NYHDKLAAIEKDRDSARKDWKKINNIKEMKEGYLSQVVHEIAKLVIEYNA

IVVFEDLNFGFKRGRFKVEKQVYQKLEKMLIEKLNYLVFKDNEFDKTGGV

LRAYQLTAPFETFKKMGKQTGIIYYVPAGFTSKICPVTGFVNQLYPKYES

VSKSQEFFSKFDKICYNLDKGYFEFSFDYKNFGDKAAKGKWTIASFGSRL

INFRNSDKNHNWDTREVYPTKELEKLLKDYSIEYGHGECIKAAICGESDK

KFFAKLTSVLNTILQMRNSKTGTELDYLISPVADVNGNFFDSRQAPKNMP

QDAAANGAYHIGLKGLMLLGRIKNNQEGKKLNLVIKNEEYFEFVQNRNN
```

*Francisella novicida* Cpf1 D917A/E1006A (SEQ ID NO: 380) (A917, A1006, and D1255 are Bolded and Underlined)

```
                                         (SEQ ID NO: 380)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTQSFYEQIAAFKTVEEKSIKETLSLLFDDLKAQKLDLSKIYF

KNDKSLTDLSQQVFDDYSVIGTAVLEYITQQIAPKNLDNPSKKEQELIA

KKTEKAKYLSLETIKLALEEFNKHRDIDKQCRFEEILANFAAIPMEDEI

AQNKDNLAQISIKYQNQGKKDLLQASAEDDVKAIKDLLDQTNNLLHKLK

IFHISQSEDKANILDKDEHFYLVFEECYFELANIVPLYNKIRNYITQKP

YSDEKFKLNFENSTLANGWDKNKEPDNTAILFIKDDKYYLGVMNKKNNK

IFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDF

GFRFSDTQRYNSIDEFYREVENQGYKLTFENISESYIDSVVNQGKLYLF

QIYNKDFSAYSKGRPNLHTLYWKALFDERNLQDVVYKLNGEAELFYRKQ

SIPKKITHPAKEAIANKNKDNPKKESVFEYDLIKDKRFTEDKFFFHCPI

TINFKSSGANKFNDEINLLLKEKANDVHILSIARGERHLAYYTLVDGKG

NIIKQDTFNIIGNDRMKTNYHDKLAAIEKDRDSARKDWKKINNIKEMKE

GYLSQVVHEIAKLVIEYNAIVVFADLNFGFKRGRFKVEKQVYQKLEKML

IEKLNYLVFKDNEFDKTGGVLRAYQLTAPFETFKKMGKQTGIIYYVPAG

FTSKICPVTGFVNQLYPKYESVSKSQEFFSKFDKICYNLDKGYFEFSFD

YKNFGDKAAKGKWTIASFGSRLINFRNSDKNHNWDTREVYPTKELEKLL

KDYSIEYGHGECIKAAICGESDKKFFAKLTSVLNTILQMRNSKTGTELD

YLISPVADVNGNFFDSRQAPKNMPQDADANGAYHIGLKGLMLLGRIKNN

QEGKKLNLVIKNEEYFEFVQNRNN
```

*Francisella novicida* Cpf1 D917A/D1255A (SEQ ID NO: 381) (A917, E1006, and A1255 are Bolded and Underlined)

```
                                         (SEQ ID NO: 381)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVFDDYSVIGTAVLEYITQQIAPKNLDNPSKKEQELI

AKKTEKAKYLSLETIKLALEEFNKHRDIDKQCRFEEILANFAAIPMWDE

IAQNKDNLAQISIKYQNQGKKDLLQASAEDDVKAIKDLLDQTNNLLHKL

KIFHISQSEDKANILDKDEHFYLVFEECYFELANIVPLYNKIRNYITQK

PYSDEKFKLNFENSTLANGWDKNKEPDNTAILFIKDDKYYLGVMNKKNN

KIFDDKAIKENKGEGYKKIVYKLLPGANKMLPKVFFSAKSIKFYNPSED

ILRIRNHSTHTKNGSPQKGYEKFEFNIEDCRKFIDFYKQSISKHPEWKD

FGFRFSDTQRYNSIDEFYREVENQGYKLTFENISESYIDSVVNQGKLYL

FQIYNKDFSAYSKGRPNLHTLYWKALFDERNLQDVVYKLNGEAELFYRK

QSIPKKITHPAKEAIANKNKDNPKKESVFEYDLIKDKRFTEDKFFFHCP

ITINFKSSGANKFNDEINLLLKEKANDVHILSIARGERHLAYYTLVDGK

GNIIKQDTFNIIGNDRMKTNYHDKLAAIEKDRDSARKDWKKINNIKEMK

EGYLSQVVHEIAKLVIEYNAIVVFEDLNFGFKRGRFKVEKQVYQKLEKM

LIEKLNYLVFKDNEFDKTGGVLRAYQLTAPFETFKKMGKQTGIIYYVPA

GFTSKICPVTGFVNQLYPKYESVSKSQEFFSKFDKICYNLDKGYFEFSF

DYKNFGDKAAKGKWTIASFGSRLINFRNSDKNHNWDTREVYPTKELEKL

LKDYSIEYGHGECIKAAICGESDKKFFAKLTSVLNTILQMRNSKTGTEL

DYLISPVADVNGNFFDSRQAPKNMPQDAAANGAYHIGLKGLMLLGRIKN

NQEGKKLNLVIKNEEYFEFVQNRNN
```

*Francisella novicida* Cpf1 E1006A/D1255A (SEQ ID NO: 382) (D917, A1006, and A1255 are Bolded and Underlined)

```
                                         (SEQ ID NO: 382)
MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF
```

-continued

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVFDDYSVIGTAVLEYITQQIAPKNLDNPSKKEQELI

AKKTEKAKYLSLETIKLALEEFNKHRDIDKQCRFEEILANFAAIPMWDE

IAQNKDNLAQISIKYQNQGKKDLLQASAEDDVKAIKDLLDQTNNLLHKL

KIFHISQSEDKANILDKDEHFYLVFEECYFELANIVPLYNKIRNYITQK

PYSDEKFKLNFENSTLANGWDKNKEPDNTAILFIKDDKYYLGVMNKKNN

KIFDDKAIKENKGEGYKKIVYKLLPGANKMLPKVFFSAKSIKFYNPSED

ILRIRNHSTHTKNGSPQKGYEKFEFNIEDCRKFIDFYKQSISKHPEWKD

FGFRFSDTQRYNSIDEFYREVENQGYKLTFENISESYIDSVVNQGKLYL

FQIYNKDFSAYSKGRPNLHTLYWKALFDENLQDVVYKLNGEAELFYRKQ

SIPKKITHPAKEAIANKNKDNPKKESVFEYDLIKDKRFTEDKFFFHCPI

TINFKSSGANKFNDEINLLLKEKANDVHILSIDRGERHLAYYTLVDGKG

NIIKQDTFNIIGNDRMKTNYHDKLAAIEKDRDSARKDWKKINNIKEMKE

GYLSQVVHEIAKLVIEYNAIVVFADLNFGFKRGRFKVEKQVYQKLEKML

IEKLNYLVFKDNEFDKTGGVLRAYQLTAPFETFKKMGKQTGIIYYVPAG

FTSKICPVTGFVNQLYPKYESVSKSQEFFSKFDKICYNLDKGYFEFSFD

YKNFGDKAAKGKWTIASFGSRLINFRNSDKNHNWDTREVYPTKELEKLL

KDYSIEYGHGECIKAAICGESDKKFFAKLTSVLNTILQMRNSKTGTELD

YLISPVADVNGNFFDSRQAPKNMPQDAAANGAYHIGLKGLMLLGRIKNN

QEGKKLNLVIKNEEYFEFVQNRNN

*Francisella novicida* Cpf1 D917A/E1006A/D1255A (SEQ ID NO: 383) (A917, A1006, and A1255 are Bolded and Underlined)

(SEQ ID NO: 383)

MSIYQEFVNKYSLSKTLRFELIPQGKTLENIKARGLILDDEKRAKDYKK

AKQIIDKYHQFFIEEILSSVCISEDLLQNYSDVYFKLKKSDDDNLQKDF

KSAKDTIKKQISEYIKDSEKFKNLFNQNLIDAKKGQESDLILWLKQSKD

NGIELFKANSDITDIDEALEIIKSFKGWTTYFKGFHENRKNVYSSNDIP

TSIIYRIVDDNLPKFLENKAKYESLKDKAPEAINYEQIKKDLAEELTFD

IDYKTSEVNQRVFSLDEVFEIANFNNYLNQSGITKFNTIIGGKFVNGEN

TKRKGINEYINLYSQQINDKTLKKYKMSVLFKQILSDTESKSFVIDKLE

DDSDVVTTMQSFYEQIAAFKTVEEKSIKETLSLLFDDLKAQKLDLSKIY

FKNDKSLTDLSQQVFDDYSVIGTAVLEYITQQIAPKNLDNPSKKEQELI

AKKTEKAKYLSLETIKLALEEFNKHRDIDKQCRFEEILANFAAIPMWDE

IAQNKDNLAQISIKYQNQGKKDLLQASAEDDVKAIDLLDQTNNLLHKLK

IFHISQSEDKANILDKDEHFYLVFEECYFELANIVPLYNKIRNYITQKP

YSDEKFKLNFENSTLANGWDKNKEPDNTAILFIKDDKYYLGVMNKKNNK

IFDDKAIKENKGEGYKKIVYKLLPGANKMLPKVFFSAKSIKFYNPSEDI

LRIRNHSTHTKNGSPQKGYEKFEFNIEDCRKFIDFYKQSISKHPEWKDF

GFRFSDTQRYNSIDEFYREVENQGYKLTFENISESYIDSVVNQGKLYLF

QIYNKDFSAYSKGRPNLHTLYWKALFDERNLQDVVYKLNGEAELFYRKQ

SIPKKITHPAKEAIANKNKDNPKKESVFEYDLIKDKRFTEDKFFFHCPI

TINFKSSGANKFNDEINLLLKEKANDVHILSIARGERHLAYYTLVDGKG

NIIKQDTFNIIGNDRMKTNYHDKLAAIEKDRDSARKDWKKINNIKEMKE

GYLSQVVHEIAKLVIEYNAIVVFADLNFGFKRGRFKVEKQVYQKLEKML

IEKLNYLVFKDNEFDKTGGVLRAYQLTAPFETFKKMGKQTGIIYYVPAG

FTSKICPVTGFVNQLYPKYESVSKSQEFFSKFDKICYNLDKGYFEFSFD

YKNFGDKAAKGKWTIASFGSRLINFRNSDKNHNWDTREVYPTKELEKLL

KDYSIEYGHGECIKAAICGESDKKFFAKLTSVLNTILQMRNSKTGTELD

YLISPVADVNGNFFDSRQAPKNMPQDAAANGAYHIGLKGLMLLGRIKNN

QEGKKLNLVIKNEEYFEFVQNRNN

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 2016 July; 34(7):768-73. PubMed PMID: 27136078; Swarts et al., *Nature.* 507(7491) (2014): 258-61; and Swarts et al., *Nucleic Acids Res.* 43(10) (2015): 5120-9, each of which is incorporated herein by reference. The sequence of *Natronobacterium gregoryi* Argonaute is provided in SEQ ID NO: 416.

Wild Type *Natronobacterium gregoryi* Argonaute (SEQ ID NO: 416)

(SEQ ID NO: 416)

MTVIDLDSTTTADELTSGHTYDISVTLTGVYDNTDEQHPRMSLAFEQDN

GERRYITLWKNTTPKDVFTYDYATGSTYIFTNIDYEVKDGYENLTATYQ

TTVENATAQEVGTTDEDETFAGGEPLDHHLDDALNETPDDAETESDSGH

VMTSFASRDQLPEWTLHTYTLTATDGAKTDTEYARRTLAYTVRQELYTD

HDAAPVATDGLMLLTPEPLGETPLDLDCGVRVEADETRTLDYTTAKDRL

LARELVEEGLKRSLWDDYLVRGIDEVLSKEPVLTCDEFDLHERYDLSVE

VGHSGRAYLHINFRHRFVPKLTLADIDDDNIYPGLRVKTTYRPRRGHIV

WGLRDECATDSLNTLGNQSVVAYHRNNQTPINTDLLDAIEAADRRVVET

RRQGHGDDAVSFPQELLAVEPNTHQIKQFASDGFHQQARSKTRLSASRC

SEKAQAFAERLDPVRLNGSTVEFSSEFFTGNNEQQLRLLYENGESVLTF

-continued

```
RDGARGAHPDETFSKGIVNPPESFEVAVVLPEQQADTCKAQWDTMADLL

NQAGAPPTRSETVQYDAFSSPESISLNVAGAIDPSEVDAAFVVLPPDQE

GFADLASPTETYDELKKALANMGIYSQMAYFDRFRDAKIFYTRNVALGL

LAAAGGVAFTTEHAMPGDADMFIGIDVSRSYPEDGASGQINIAATATAV

YKDGTILGHSSTRPQLGEKLQSTDVRDIMKNAILGYQQVTGESPTHIVI

HRDGFMNEDLDPATEFLNEQGVEYDIVEIRKQPQTRLLAVSDVQYDTPV

KSIAAINQNEPRATVATFGAPEYLATRDGGGLPRPIQIERVAGETDIET

LTRQVYLLSQSHIQVHNSTARLPITTAYADQASTHATKGYLVQTGAFES

NVGFL
```

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 438 or 439. In some embodiments, the napDNAbp comprises an amino acid sequence of any one SEQ ID NOs: 438 or 439. It should be appreciated that C2c1, C2c2, or C2c3 from other bacterial species may also be used in accordance with the present disclosure.

```
C2c1 (uniprot.org/uniprot/T0D7A2#2)
sp|T0D7A2|C2C1_ALIAG CRISPR-associated endo-
nuclease C2c1 OS = Alicyclobacillus acido-
terrestris (strain ATCC 49025/DSM 3922/
CIP 106132/NCIMB 13137/GD3B) GN = c2c1 PE = 1
S V = 1
                                   (SEQ ID NO: 438)
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR
```

-continued
MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI

C2c2 (uniprot.org/uniprot/P0DOC6)
>sp|P0DOC6|C2C2_LEPSD CRISPR-associated endoribonuclease C2c2 OS = Leptotrichia shahii (strain DSM 19757/CCUG 47503/CIP 107916/JCM 16776/LB37) GN = c2c2 PE = 1 S V = 1
(SEQ ID NO: 439)
MGNLFGHKRWYEVRDKKDFKIKRKVKVKRNYDGNKYILNINENNNKEKID

NNKFIRKYINYKKNDNILKEFTRKFHAGNILFKLKGKEGIIRIENNDDFL

ETEEVVLYIEAYGKSEKLKALGITKKKIIDEARQGITKDDKKIEIKRQEN

EEEIEIDIRDEYTNKTLNDCSIILRIIENDELETKKSIYEIFKNINMSLY

KIIEKIIENETEKVFENRYYEEHLREKLLKDDKIDVILTNFMEIREKIKS

NLEILGFVKFYLNVGGDKKKSKNKKMLVEKILNINVDLTVEDIADFVIKE

LEFWNITKRIEKVKKVNNEFLEKRRNRTYIKSYVLLDKHEKFKIERENKK

DKIVKFFVENIKNNSIKEKIEKILAEFKIDELIKKLEKELKKGNCDTEIF

GIFKKHYKVNFDSKKFSKKSDEEKELYKIIYRYLKGRIEKILVNEQKVRL

KKMEKIEIEKILNESILSEKILKRVKQYTLEHIMYLGKLRHNDIDMTTVN

TDDFSRLHAKEELDLELITFFASTNMELNKIFSRENINNDENIDFFGGDR

EKNYVLDKKILNSKIKIIRDLDFIDNKNNITNNFIRKFTKIGTNERNRIL

HAISKERDLQGTQDDYNKVINIIQNLKISDEEVSKALNLDVVFKDKKNII

TKINDIKISEENNNDIKYLPSFSKVLPEILNLYRNNPKNEPFDTIETEKI

VLNALIYVNKELYKKLILEDDLEENESKNIFLQELKKTLGNIDEIDENII

ENYYKNAQISASKGNNKAIKKYQKKVIECYIGYLRKNYEELFDFSDFKMN

IQEIKKQIKDINDNKTYERITVKTSDKTIVIDDFEYIISIFALLNSNAVI

NKIRNRFFATSVWLNTSEYQNIIDILDEIMQLNTLRNECITENWNLNLEE

-continued
FIQKMKEIEKDFDDFKIQTKKEIFNNYYEDIKNNILTEFKDDINGCDVLE

KKLEKIVIFDDETKFEIDKKSNILQDEQRKLSNINKKDLKKKVDQYIKDK

DQEIKSKILCRIIFNSDFLKKYKKEIDNLIEDMESENENKFQEIYYPKER

KNELYIYKKNLFLNIGNPNFDKIYGLISNDIKMADAKFLFNIDGKNIRKN

KISEIDAILKNLNDKLNGYSKEYKEKYIKKLKENDDFFAKNIQNKNYKSF

EKDYNRVSEYKKIRDLVEFNYLNKIESYLIDINWKLAIQMARFERDMHYI

VNGLRELGIIKLSGYNTGISRAYPKRNGSDGFYTTTAYYKFFDEESYKKF

EKICYGFGIDLSENSEINKPENESIRNYISHFYIVRNPFADYSIAEQIDR

VSNLLSYSTRYNNSTYASVFEVFKKDVNLDYDELKKKFKLIGNNDILERL

MKPKKVSVLELESYNSDYIKNLIIELLTKIENTNDTL

Fusion Proteins Comprising a Nuclease Programmable DNA Binding Protein and an Adenosine Deaminase Some aspects of the disclosure provide fusion proteins comprising a nucleic acid programmable DNA binding protein (napDNAbp) and an adenosine deaminase. In some embodiments, any of the fusion proteins provided herein are base editors. In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. Some aspects of the disclosure provide fusion proteins comprising a Cas9 domain and an adenosine deaminase. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the fusion protein comprises the structure:
NH$_2$-[adenosine deaminase][napDNAbp]-COOH; or
NH$_2$-[napDNAbp]-[adenosine deaminase]-COOH In some embodiments, the fusion proteins comprising an adenosine deaminase and a napDNAbp (e.g., Cas9 domain) do not include a linker sequence. In some embodiments, a linker is present between the adenosine deaminase domain and the napDNAbp. In some embodiments, the "-" used in the general architecture above indicates the presence of an optional linker. In some embodiments, the adenosine deaminase and the napDNAbp are fused via any of the linkers provided herein. For example, in some embodiments the adenosine deaminase and the napDNAbp are fused via any of the linkers provided below in the section entitled "Linkers". In some embodiments, the adenosine deaminase and the napDNAbp are fused via a linker that comprises between 1 and and 200 amino acids. In some embodiments, the adenosine deaminase and the napDNAbp are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the napDNAbp are fused via a linker that comprises 4, 16, 32, or 104 amino acids in length. In some embodiments, the adenosine deaminase and the napDNAbp are fused via a linker that comprises the amino acid sequence of SGSETPGTSESATPES (SEQ ID NO: 10), SGGS (SEQ ID NO: 37), SGGSSGSETPGTSESAT-PESSGGS (SEQ ID NO: 384), SGGSSGGSSGSETPGT-SESATPESSGGSSGGS (SEQ ID NO: 385), or GGSGGSPGSPAGSPTSTEEGTSESATPESGPGT-STEPSEGSAPGSPAGSPTSTEEGTSTE PSEGSAPGT-STEPSEGSAPGTSESATPESGPGSEPATSGGSGGS (SEQ ID NO: 386). In some embodiments, the adenosine deaminase and the napDNAbp are fused via a linker comprising the amino acid sequence SGSETPGTSESATPES (SEQ ID NO: 10), which may also be referred to as the XTEN linker. In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence SGGSSGGSSGSETPGTSESAT-PESSGGSSGGSSGGSSGGS (SEQ ID NO: 686). In some embodiments, the linker is 64 amino acids in length. In some embodiments, the linker comprises the amino acid sequence SGGSSGGSSGSETPGTSESAT-PESSGGSSGGSSGGSSGGSSGGSGSETPGTSESAT-PESSGGS SGGS (SEQ ID NO: 687). In some embodiments, the linker is 92 amino acids in length. In some embodiments, the linker comprises the amino acid sequence PGSPAGSPTSTEEGTSESATPESGPGTSTEPSEGSAPG-SPAGSPTSTEEGTSTEPSEGSAP GTSTEPSEGSAPGT-SESATPESGPGSEPATS (SEQ ID NO: 688).

Fusion Proteins Comprising an Inhibitor of Base Repair

Some aspects of the disclosure provide fusion proteins that comprise an inhibitor of base repair (IBR). For example a fusion protein comprising an adenosine deaminase and a nucleic acid programmable DNA binding protein may further comprise an inhibitor of base repair. In some embodiments, the IBR comprises an inhibitor of inosine base repair. In some embodiments, the IBR is an inhibitor of inosine base excision repair. In some embodiments, the inhibitor of inosine base excision repair is a catalytically inactive inosine specific nuclease (dISN).

In some embodiments, the fusion proteins provided herein further comprise a catalytically inactive inosine-specific nuclease (dISN). In some embodiments, any of the fusion proteins provided herein that comprise a napDNAbp (e.g., a nuclease active Cas9 domain, a nuclease inactive dCas9 domain, or a Cas9 nickase) and an adenosine deaminase may be further fused to a catalytically inactive inosine-specific nuclease (dISN) either directly or via a linker. Some aspects of this disclosure provide fusion proteins that comprise an adenosine deaminase (e.g., an engineered adenosine deaminase that deaminates adenosine in a DNA) a napDNAbp (e.g., a dCas9 or nCas9), and a dISN. Without wishing to be bound by any particular theory, cellular DNA-repair response to the presence of I:T heteroduplex DNA may be responsible for the decrease in nucleobase editing efficiency in cells. For example, AAG catalyzes removal of inosine (I) from DNA in cells, which may initiate base excision repair, with reversion of the I:T pair to a A:T pair as the most common outcome. In some embodiments, a catalytically inactive inosine-specific nuclease may be capable of binding an inosine in a nucleic acid, without cleaving the nucleic acid, to prevent removal (e.g., by cellular DNA repair mechanisms) of the inosine residue in the DNA.

In some embodiments, a dISN may inhibit (e.g., by steric hindrance) inosine removing enzymes from excising the inosine residue from DNA. For example, catalytically dead inosine glycosylases (e.g., alkyl adenine glycosylase [AAG]) will bind inosine but will not create an abasic site or remove the inosine, thereby sterically blocking the newly-formed inosine moiety from potential DNA damage/repair mechanisms. Thus, this disclosure contemplates a fusion protein comprising a napDNAbp and an adenosine deaminase further fused to a dISN. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a dISN may increase the editing efficiency of a adenosine deaminase that is capable of catalyzing a A to I change. For example, fusion proteins comprising a dISN domain may be more efficient in deaminating A residues. In some embodiments, the fusion protein comprises the structure:

$NH_2$-[adenosine deaminase]-[napDNAbp]-[dISN]-COOH;
$NH_2$-[adenosine deaminase]-[dISN]-[napDNAbp]-COOH;
$NH_2$-[dISN]-[adenosine deaminase]-[napDNAbp]-COOH;
$NH_2$-[napDNAbp]-[adenosine deaminase][dISN]-COOH;
$NH_2$-[napDNAbp]-[dISN]-[adenosine deaminase]-COOH; or
$NH_2$-[dISN]-[napDNAbp]-[adenosine deaminase]-COOH In some embodiments, the fusion proteins provided herein do not comprise a linker. In some embodiments, a linker is present between two domains or proteins (e.g., adenosine deaminase, napDNAbp, or dISN). In some embodiments, the "-" used in the general architecture above indicates the presence of an optional linker sequence. In some embodiments, a dISN comprises an inosine-specific nuclease that has reduced or nuclease activity, or does not have nuclease activity. In some embodiments, a dISN has up to 1%, up to 2%, up to 3%, up to 4%, up to 5%, up to 10%, up to 15%, up to 20%, up to 25%, up to 30%, up to 35%, up to 40%, up to 45%, or up to 50% of the nuclease activity of a corresponding (e.g., the wild-type) inosine-specific nuclease. In some embodiments, the dISN is a wild-type inosine-specific nuclease that comprises one or more mutations that reduces or eliminates the nuclease activity of the wild-type inosine-specific nuclease. Exemplary catalytically inactive inosine-specific nucleases include, without limitation, catalytically inactive AAG nuclease and catalytically inactive EndoV nuclease. In some embodiments, the catalytically inactive AAG nuclease comprises an E125Q mutation as compared to SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as compared to SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure.

In some embodiments, the dISN proteins provided herein include fragments of dISN proteins and proteins homologous to a dISN or a dISN fragment. For example, in some embodiments, a dISN comprises a fragment of the amino acid sequence set forth in SEQ ID NO: 32 or 33. In some embodiments, a dISN fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 32 or 33. In some embodiments, a dISN comprises an amino acid sequence homologous to the amino acid sequence set forth in SEQ ID NO: 32 or 33, or an amino acid sequence homologous to a fragment of the amino acid sequence set forth in SEQ ID NO: 32 or 33. In some embodiments, proteins comprising a dISN or fragments of a dISN or homologs of a dISN or a dISN fragment are referred to as "dISN variants." A dISN variant shares homology to a dISN, or a fragment thereof. For example a dISN variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type dISN or a dISN as set forth in SEQ ID NO: 32 or 33. In some embodiments, the dISN variant comprises a fragment of dISN, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type dISN or a dISN as set forth in SEQ ID NO: 32 or 33. In some embodiments, the dISN comprises the following amino acid sequence:

AAG nuclease (E125Q); mutated residue underlined in bold.

(SEQ ID NO: 32)
KGHLTRLGLEFFDQPAVPLARAFLGQVLVRRLPNGTELRGRIVETQAYLG

PEDEAAHSRGGRQTPRNRGMFMKPGTLYVYIIYGMYFCMNISSQGDGACV

LLRALEPLEGLETMRQLRSTLRKGTASRVLKDRELCSGPSKLCQALAINK

SFDQRDLAQDEAVWLERGPLEPSEPAVVAAARVGVGHAGEWARKPLRFYV

RGSPWVSVVDRVAEQDTQA

EndoV nuclease (D35A); mutated residue underlined in bold.

(SEQ ID NO: 33)
DLASLRAQQIELASSVIREDRLDKDPPDLIAGAAVGFEQGGEVTRAAMVL

LKYPSLELVEYKVARIATTMPYIPGFLSFREYPALLAAWEMLSQKPDLVF

VDGHGISHPRRLGVASHFGLLVDVPTIGVAKKRLCGKFEPLSSEPGALAP

LMDKGEQLAWVWRSKARCNPLFIATGHRVSVDSALAWVQRCMKGYRLPEP

TRWADAVASERPAFVRYTANQP

Suitable dISN proteins are provided herein and additional suitable dISN proteins are known to those in the art, and include, for example, AAG, EndoV, and variants thereof. It should be appreciated that additional proteins that block or inhibit base-excision repair, such as base excision of an inosine, are also within the scope of this disclosure. In some embodiments, a protein that binds inosine in DNA is used.

Some aspects of the disclosure relate to fusion proteins that comprise MBD4, or TDG, which may be used as inhibitors of base repair. Thus, this disclosure contemplates a fusion protein comprising a napDNAbp and an adenosine deaminase further fused to MBD4 or TDG. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of MBD4 or TDG may increase the editing efficiency of a adenosine deaminase that is capable of catalyzing a A to I change. For example, fusion proteins comprising MBD4 or TDG may be more efficient in deaminating A residues. In some embodiments, the fusion protein comprises the structure:

NH$_2$-[adenosine deaminase]-[napDNAbp]-[MBD4 or TDG]-COOH;

NH$_2$-[adenosine deaminase]-[MBD4 or TDG][napDNAbp]-COOH;

NH$_2$-[MBD4 or TDG]-[adenosine deaminase]-[napDNAbp]-COOH;

NH$_2$-[napDNAbp]-[adenosine deaminase]-[MBD4 or TDG]-COOH;

NH$_2$-[napDNAbp]-[MBD4 or TDG]-[adenosine deaminase]-COOH; or

NH$_2$-[MBD4 or TDG]-[napDNAbp]-[adenosine deaminase]-COOH

In some embodiments, the fusion proteins provided herein do not comprise a linker. In some embodiments, a linker is present between two domains or proteins (e.g., adenosine deaminase, napDNAbp, MBD4 or TDG). In some embodiments, the "-" used in the general architecture above indicates the presence of an optional linker sequence. In some embodiments, the MBD4 or TDG is a wild-type MBD4 or TDG. Exemplary, MBD4 and TDG amino acid sequences would be apparent to the skilled artisan and include, without limitation, the MBD4 and TDG amino acid sequences provided below.

Sequence of MBD4:
(SEQ ID NO: 689)
GTTGLESLSLGDRGAAPTVTSSERLVPDPPNDLRKEDVAMELERVGEDEE

QMMIKRSSECNPLLQEPIASAQFGATAGTECRKSVPCGWERVVKQRLFGK

TAGRFDVYFISPQGLKFRSKSSLANYLHKNGETSLKPEDFDFTVLSKRGI

KSRYKDCSMAALTSHLQNQSNNSNWNLRTRSKCKKDVFMPPSSSSELQES

RGLSNFTSTHLLLKEDEGVDDVNFRKVRKPKGKVTILKGIPIKKTKKGCR

KSCSGFVQSDSKRESVCNKADAESEPVAQKSQLDRTVCISDAGACGETLS

VTSEENSLVKKKERSLSSGSNFCSEQKTSGIINKFCSAKDSEHNEKYEDT

FLESEEIGTKVEVVERKEHLHTDILKRGSEMDNNCSPTRKDFTGEKIFQE

DTIPRTQIERRKTSLYFSSKYNKEALSPPRRKAFKKWTPPRSPFNLVQET

LFHDPWKLLIATIFLNRTSGKMAIPVLWKFLEKYPSAEVARTADWRDVSE

LLKPLGLYDLRAKTIVKFSDEYLTKQWKYPIELHGIGKYGNDSYRIFCVN

EWKQVHPEDHKLNKYHDWLWENHEKLSLS

Sequence of TDG:
(SEQ ID NO: 690)
EAENAGSYSLQQAQAFYTFPFQQLMAEAPNMAVVNEQQMPEEVPAPAPAQ

EPVQEAPKGRKRKPRTTEPKQPVEPKKPVESKKSGKSAKSKEKQEKITDT

FKVKRKVDRFNGVSEAELLTKTLPDILTFNLDIVIIGINPGLMAAYKGHH

YPGPGNHFWKCLFMSGLSEVQLNHMDDHTLPGKYGIGFTNMVERTTPGSK

DLSSKEFREGGRILVQKLQKYQPRIAVFNGKCIYEIFSKEVFGVKVKNLE

FGLQPHKIPDTETLCYVMPSSSARCAQFPRAQDKVHYYIKLKDLRDQLKG

-continued

IERNMDVQEVQYTFDLQLAQEDAKKMAVKEEKYDPGYEAAYGGAYGENPC

SSEPCGFSSNGLIESVELRGESAFSGIPNGQWMTQSFTDQIPSFSNHCGT

QEQEEESHA

In some embodiments, the MBD4 or TDG proteins provided herein include fragments of MBD4 or TDG proteins and proteins homologous to a MBD4 or a TDG fragment. For example, in some embodiments, a MBD4 or TDG protein comprises a fragment of the amino acid sequence set forth in SEQ ID NO: 689 or 690. In some embodiments, a MBD4 or TDG fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 689 or 690. In some embodiments, a MBD4 or TDG protein comprises an amino acid sequence homologous to the amino acid sequence set forth in SEQ ID NO: 689 or 690, or an amino acid sequence homologous to a fragment of the amino acid sequence set forth in SEQ ID NO: 689 or 690. In some embodiments, proteins comprising a MBD4 or TDG or fragments of a MBD4 or TDG or homologs of a MBD4 or TDG fragment are referred to as "MBD4 varients" or "TDG variants." A MBD4 or TDG variant shares homology to a MBD4 or TDG, or a fragment thereof. For example a MBD4 or TDG variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type MBD4 or TDG or a MBD4 or TDG as set forth in SEQ ID NO: 689 or 690. In some embodiments, the MBD4 or TDG variant comprises a fragment of MBD4 or TDG, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type MBD4 or TDG or a MBD4 or TDG as set forth in SEQ ID NO: 689 or 690. In some embodiments, the dISN comprises the following amino acid sequence:

Some aspects of the disclosure relate to fusion proteins that comprise a uracil glycosylase inhibitor (UGI) domain. In some embodiments, any of the fusion proteins provided herein that comprise a napDNAbp (e.g., a nuclease active Cas9 domain, a nuclease inactive dCas9 domain, or a Cas9 nickase), and an adenosine deaminase, may be further fused to a UGI domain either directly or via a linker. Some aspects of this disclosure provide fusion proteins that comprise an adenosine deaminase (e.g., an engineered adenosine deaminase that deaminates deoxyadenosine in a DNA) a napDNAbp (e.g., a dCas9 or nCas9), and a UGI domain. Without wishing to be bound by any particular theory, the cellular DNA-repair response to the presence of I:T heteroduplex DNA may be responsible for the decrease in nucleobase editing efficiency in cells. For example, alkyl adenosine glycosylase (AAG) is involved in inosine (I) associated DNA repair and catalyzes removal of I from DNA in cells. This may initiate base excision repair, with reversion of the I:T pair to a A:T pair as the most common outcome. A UGI domain, may inhibit (e.g., by steric hindrance) inosine removing enzymes from excising the inosine residue from DNA. Thus, this disclosure contemplates a fusion protein comprising a Cas9 domain and an adenosine deaminase domain further fused to a UGI domain. This disclosure contemplates a fusion protein comprising any nucleic acid programmable DNA binding protein, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a UGI domain may increase the editing efficiency of a adenosine deaminase that is capable of catalyzing a A to I change. For example, fusion proteins comprising a UGI domain may be more efficient in deaminating adenosine residues. In some embodiments, the fusion protein comprises the structure:

NH$_2$-[adenosine deaminase]-[napDNAbp]-[UGI]-[COOH];
NH$_2$-[adenosine deaminase]-[UGI]-[napDNAbp]-COOH;
NH$_2$-[UGI]-[adenosine deaminase]-[napDNAbp]-COOH;
NH$_2$-[napDNAbp]-[adenosine deaminase]-[UGI]-COOH;
NH$_2$-[napDNAbp]-[UGI]-[adenosine deaminase]-COOH;
or
NH$_2$-[UGI]-[napDNAbp]-[adenosine deaminase]-COOH In some embodiments, the fusion proteins provided herein do not comprise a linker. In some embodiments, a linker is present between any of the domains or proteins (e.g., adenosine deaminase, napDNAbp, and/or UGI domains). In some embodiments, the "-" used in the general architecture above indicates the presence of an optional linker.

In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3 or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence:

>sp|P14739|UNGI_BPPB2 Uracil-DNA glycosylase inhibitor
(SEQ ID NO: 3)
MTNLSDIIEKETGKQLVIQESILMLPEEVEEVIGNKPESDILVHTAYDES
TDENVMLLTSDAPEYKPWALVIQDSNGENKIKML Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of each are incorporated herein by reference.

It should be appreciated that additional proteins that block or inhibit base-excision repair, such as base excision of an inosine, are also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 29). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 30). As another example, a uracil glycosylase inhibitor is a catalytically inactive UDG. In some embodiments, a catalytically inactive UDG comprises the amino acid sequence (SEQ ID NO: 31). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 29-31. In some embodiments, a uracil glycosylase inhibitor is a protein that is at least 50% identical, at least 55% identical, at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 29-31.

*Erwinia tasmaniensis* SSB (themostable single-stranded DNA binding protein)
(SEQ ID NO: 29)
MASRGVNKVILVGNLGQDPEVRYMPNGGAVANITLATSESWRDKQTGETK

EKTEWHRVVLFGKLAEVAGEYLRKGSQVYIEGALQTRKWTDQAGVEKYTT

EVVVNVGGTMQMLGGRSQGGGASAGGQNGGSNNGWGQPQQPQGGNQFSGG

AQQQARPQQQPQQNNAPANNEPPIDFDDDIP

UdgX (binds to Uracil in DNA but does not excise)
(SEQ ID NO: 30)
MAGAQDFVPHTADLAELAAAAGECRGCGLYRDATQAVFGAGGRSARIMMI

GEQPGDKEDLAGLPFVGPAGRLLDRALEAADIDRDALYVTNAVKHFKFTR

AAGGKRRIHKTPSRTEVVACRPWLIAEMTSVEPDVVVLLGATAAKALLGN

DFRVTQHRGEVLHVDDVPGDPALVATVHPSSLLRGPKEERESAFAGLVDD

LRVAADVRP

UDG (catalytically inactive human UDG, binds to Uracil in DNA but does not excise)
(SEQ ID NO: 31)
MIGQKTLYSFFSPSPARKRHAPSPEPAVQGTGVAGVPEESGDAAAIPAKK

APAGQEEPGTPPSSPLSAEQLDRIQRNKAAALLRLAARNVPVGFGESWKK

HLSGEFGKPYFIKLMGFVAEERKHYTVYPPPHQVFTWTQMCDIKDVKVVI

LGQEPYHGPNQAHGLCFSVQRPVPPPPSLENIYKELSTDIEDFVHPGHGD

LSGWAKQGVLLLNAVLTVRAHQANSHKERGWEQFTDAVVSWLNQNSNGLV

FLLWGSYAQKKGSAIDRKRHHVLQTAHPSPLSVYRGFFGCRHFSKTNELL

QKSGKKPIDWKEL

Fusion Proteins Comprising a Nuclear Localization Sequence (NLS)

In some embodiments, the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the IBR (e.g., dISN). In some embodiments, the NLS is fused to the C-terminus of the IBR (e.g., dISN). In some embodiments, the NLS is fused to the N-terminus of the napDNAbp. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 4 or SEQ ID NO: 5. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLYQFKNVRWAKGRRETYLC (SEQ ID NO: 5).

In some embodiments, the general architecture of exemplary fusion proteins with an adenosine deaminase and a napDNAbp comprises any one of the following structures, where NLS is a nuclear localization sequence (e.g., any NLS provided herein), NH₂ is the N-terminus of the fusion protein, and COOH is the C-terminus of the fusion protein.

Fusion proteins comprising an adenosine deaminase, a napDNAbp, and a NLS.

NH₂-[NLS]-[adenosine deaminase]-[napDNAbp]-COOH;
NH₂-[adenosine deaminase]-[NLS]-[napDNAbp]-COOH;
NH₂-[adenosine deaminase]-[napDNAbp]-[NLS]-COOH;
NH₂-[NLS]-[napDNAbp]-[adenosine deaminase]-COOH;
NH₂-[napDNAbp]-[NLS]-[adenosine deaminase]-COOH;
NH₂-[napDNAbp]-[adenosine deaminase]-[NLS]-COOH;

In some embodiments, the fusion proteins provided herein do not comprise a linker. In some embodiments, a linker is present between one or more of the domains or proteins (e.g., adenosine deaminase, napDNAbp, and/or NLS). In some embodiments, the "-" used in the general architecture above indicates the presence of an optional linker.

Fusion proteins comprising an adenosine deaminase, a napDNAbp, and an inhibitor of base repair (IBR).

NH₂-[IBR]-[adenosine deaminase]-[napDNAbp]-COOH;
NH₂-[adenosine deaminase]-[IBR]-[napDNAbp]-COOH;
NH₂-[adenosine deaminase]-[napDNAbp]-[IBR]-COOH;
NH₂-[IBR]-[napDNAbp]-[adenosine deaminase]-COOH;
NH₂-[napDNAbp]-[IBR]-[adenosine deaminase]-COOH;
NH₂-[napDNAbp]-[adenosine deaminase]-[IBR]-COOH;

In some embodiments, the fusion proteins provided herein do not comprise a linker. In some embodiments, a linker is present between one or more of the domains or proteins (e.g., adenosine deaminase, napDNAbp, and/or IBR). In some embodiments, the "-" used in the general architecture above indicates the presence of an optional linker.

Fusion proteins comprising an adenosine deaminase, a napDNAbp, an inhibitor of base repair (IBR) and a NLS.

NH₂-[IBR]-[NLS]-[adenosine deaminase]-[napDNAbp]-COOH;
NH₂-[NLS]-[IBR]-[adenosine deaminase]-[napDNAbp]-COOH;
NH₂-[NLS]-[adenosine deaminase]-[IBR]-[napDNAbp]-COOH;
NH₂-[NLS]-[adenosine deaminase]-[napDNAbp]-[IBR]-COOH;
NH₂-[IBR]-[adenosine deaminase]-[NLS]-[napDNAbp]-COOH;
NH₂-[adenosine deaminase]-[IBR]-[NLS]-[napDNAbp]-COOH;
NH₂-[adenosine deaminase]-[NLS]-[IBR]-[napDNAbp]-COOH;
NH₂-[adenosine deaminase]-[NLS]-[napDNAbp]-[IBR]-COOH;
NH₂-[IBR]-[adenosine deaminase]-[napDNAbp]-[NLS]-COOH;
NH₂-[adenosine deaminase]-[IBR]-[napDNAbp]-[NLS]-COOH;
NH₂-[adenosine deaminase][napDNAbp]-[IBR]-[NLS]-COOH;
NH₂-[adenosine deaminase]-[napDNAbp]-[NLS]-[IBR]-COOH;
NH₂-[IBR]-[NLS]-[napDNAbp]-[adenosine deaminase]-COOH;
NH₂-[NLS]-[IBR]-[napDNAbp]-[adenosine deaminase]-COOH;
NH₂-[NLS]-[napDNAbp]-[IBR]-[adenosine deaminase]-COOH;
NH₂-[NLS]-[napDNAbp]-[adenosine deaminase]-[IBR]-COOH;
NH₂-[IBR][napDNAbp]-[NLS]-[adenosine deaminase]-COOH;
NH₂-[napDNAbp]-[IBR]-[NLS]-[adenosine deaminase]-COOH;
NH₂-[napDNAbp]-[NLS]-[IBR]-[adenosine deaminase]-COOH;
NH₂-[napDNAbp]-[NLS]-[adenosine deaminase]-[IBR]-COOH;
NH₂-[IBR]-[napDNAbp]-[adenosine deaminase]-[NLS]-COOH;
NH₂-[napDNAbp]-[IBR]-[adenosine deaminase]-[NLS]-COOH;
NH₂-[napDNAbp]-[adenosine deaminase][IBR]-[NLS]-COOH;
NH₂-[napDNAbp]-[adenosine deaminase]-[NLS]-[IBR]-COOH;

In some embodiments, the fusion proteins provided herein do not comprise a linker. In some embodiments, a linker is present between one or more of the domains or proteins (e.g., adenosine deaminase, napDNAbp, NLS, and/or IBR). In some embodiments, the "-" used in the general architecture above indicates the presence of an optional linker.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 72, which contains a A106V, D108N, D147Y, and E155V mutation from ecTadA (SEQ ID NO: 1). As another example, the fusion protein may comprise a first adenosine deaminase domain that comprises the amino amino acid sequence of SEQ ID NO: 72, which contains a A106V, D108N, D147Y, and E155V mutation from ecTadA (SEQ ID NO: 1), and a second adenosine deaminase that comprises the amino acid sequence of SEQ ID NO: 421, which contains a L84F, A106V, D108N, H123Y, D147Y, E155V, and I156F mutation from ecTadA (SEQ ID NO: 1).

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the linker comprises the amino acid sequence of any one of SEQ ID NOs: 10, 37-40, 384-386, or 685-688. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the first adenosine deaminase comprises the amino acid sequence of SEQ ID NO: 1. In some embodiments, the second adenosine deaminase comprises an amino acid sequence that is at least least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the second adenosine deaminase comprises the amino acid sequence of SEQ ID NO: 1. In some embodiments, the first adenosine deaminase and the second adenosine deaminase of the fusion protein comprise the mutations in ecTadA (SEQ ID NO: 1), or corresponding mutations in another adenosine deaminase, as shown in any one of the constructs provided in Table 4 (e.g., pNMG-371, pNMG-477, pNMG-576, pNMG-586, and pNMG-616). In some embodiments, the fusion protein comprises the two adenosine deaminases (e.g., a first adenosine deaminase and a second adenosine deaminase) of any one of the constructs (e.g., pNMG-371, pNMG-477, pNMG-576, pNMG-586, and pNMG-616) in Table 4.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), $NH_2$ is the N-terminus of the fusion protein, and COOH is the C-terminus of the fusion protein.

Fusion proteins comprising a first adenosine deaminase, a second adenosine deaminase, and a napDNAbp.

$NH_2$-[first adenosine deaminase]-[second adenosine deaminase]-[napDNAbp]-COOH;
$NH_2$-[first adenosine deaminase]-[napDNAbp]-[second adenosine deaminase]-COOH;
$NH_2$-[napDNAbp]-[first adenosine deaminase]-[second adenosine deaminase]-COOH;
$NH_2$-[second adenosine deaminase]-[first adenosine deaminase]-[napDNAbp]-COOH;
$NH_2$-[second adenosine deaminase]-[napDNAbp]-[first adenosine deaminase]-COOH;
$NH_2$-[napDNAbp]-[second adenosine deaminase]-[first adenosine deaminase]-COOH;

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "-" used in the general architecture above indicates the presence of an optional linker.

Fusion proteins comprising a first adenosine deaminase, a second adenosine deaminase, a napDNAbp, and an NLS.

$NH_2$-[NLS]-[first adenosine deaminase]-[second adenosine deaminase]-[napDNAbp]-COOH;
$NH_2$-[first adenosine deaminase]-[NLS]-[second adenosine deaminase]-[napDNAbp]-COOH;
$NH_2$-[first adenosine deaminase]-[second adenosine deaminase]-[NLS]-[napDNAbp]-COOH;
$NH_2$-[first adenosine deaminase]-[second adenosine deaminase]-[napDNAbp]-[NLS]-COOH;
$NH_2$-[NLS]-[first adenosine deaminase]-[napDNAbp]-[second adenosine deaminase]-COOH;
$NH_2$-[first adenosine deaminase]-[NLS]-[napDNAbp]-[second adenosine deaminase]-COOH;
$NH_2$-[first adenosine deaminase]-[napDNAbp]-[NLS]-[second adenosine deaminase]-COOH;
$NH_2$-[first adenosine deaminase]-[napDNAbp]-[second adenosine deaminase]-[NLS]-COOH;
$NH_2$-[NLS]-[napDNAbp]-[first adenosine deaminase]-[second adenosine deaminase]-COOH;
$NH_2$-[napDNAbp]-[NLS]-[first adenosine deaminase]-[second adenosine deaminase]-COOH;
$NH_2$-[napDNAbp]-[first adenosine deaminase]-[NLS]-[second adenosine deaminase]-COOH;
$NH_2$-[napDNAbp]-[first adenosine deaminase]-[second adenosine deaminase]-[NLS]-COOH;
$NH_2$-[NLS]-[second adenosine deaminase]-[first adenosine deaminase]-[napDNAbp]-COOH;
$NH_2$-[second adenosine deaminase]-[NLS]-[first adenosine deaminase]-[napDNAbp]-COOH;
$NH_2$-[second adenosine deaminase]-[first adenosine deaminase]-[NLS]-[napDNAbp]-COOH;
$NH_2$-[second adenosine deaminase]-[first adenosine deaminase]-[napDNAbp]-[NLS]-COOH;
$NH_2$-[NLS]-[second adenosine deaminase]-[napDNAbp]-[first adenosine deaminase]-COOH;
$NH_2$-[second adenosine deaminase]-[NLS]-[napDNAbp]-[first adenosine deaminase]-COOH;
$NH_2$-[second adenosine deaminase]-[napDNAbp]-[NLS]-[first adenosine deaminase]-COOH;
$NH_2$-[second adenosine deaminase]-[napDNAbp]-[first adenosine deaminase]-[NLS]-COOH;
$NH_2$-[NLS]-[napDNAbp]-[second adenosine deaminase]-[first adenosine deaminase]-COOH;
$NH_2$-[napDNAbp]-[NLS]-[second adenosine deaminase]-[first adenosine deaminase]-COOH;
$NH_2$-[napDNAbp]-[second adenosine deaminase]-[NLS]-[first adenosine deaminase]-COOH;
$NH_2$-[napDNAbp]-[second adenosine deaminase]-[first adenosine deaminase]-[NLS]-COOH;

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "-" used in the general architecture above indicates the presence of an optional linker.

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises (SGGS)$_n$ (SEQ ID NO: 37), (GGGS)n (SEQ ID NO: 38), (GGGGS)n (SEQ ID NO: 39), (G)n, (EAAAK)n (SEQ ID NO: 40), (GGS)n, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 10), and SGGS (SEQ ID NO: 37). In some embodiments, a linker comprises SGGSSGSETPGTSESATPESSGGS (SEQ ID NO: 384). In some embodiments, a linker comprises SGGSSGGSSGSETPGTSESATPESSGGSSGGS (SEQ ID NO: 385). In some embodiments, a linker comprises GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 386). In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence SGGSSGGSSGSETPGTSESATPESSGGSSGGSSGGSSGGS (SEQ ID NO: 686). In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGS SGGS (SEQ ID NO: 687). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAP GTSTEPSEGSAPGTSESATPESGPGSEPATS (SEQ ID NO: 688). It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase), a nucleic acid programmable DNA binding protein (napDNAbp), and or an inhibitor of base repair (IBR). Various linker lengths and flexibilities between an adenosine deaminase (e.g., an engineered ecTadA) and a napDNAbp (e.g., a Cas9 domain), and/or between a first adenosine deaminase and a second adenosine deaminase can be employed (e.g., ranging from very flexible linkers of the form (GGGGS)n (SEQ ID NO: 38), (GGGGS)n (SEQ ID NO: 39), and (G)n to more rigid linkers of the form (EAAAK)n (SEQ ID NO: 40), (SGGS)n (SEQ ID NO: 37), SGSETPGTSESATPES (SEQ ID NO: 10) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP)$_n$) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising the amino acid sequence SGSETPGTSESATPES (SEQ ID NO: 10), SGGS (SEQ ID NO: 37), SGGSSGSETPGTSESATPESSGGS (SEQ ID NO: 384), SGGSSGGSSGSETPGTSESATPESSGGSSGGS (SEQ ID NO: 385), or GGSGGSPGSPAGSPTSTEEGTSESATPESGPGTSTEPSEGSAPGSPAGSPTSTEEGTSTE PSEGSAPGTSTEPSEGSAPGTSESATPESGPGSEPATSGGSGGS (SEQ ID NO: 386). In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence SGGSSGGSSGSETPGTSESATPESSGGSSGGSSGGSSGGSSGGS (SEQ ID NO: 686). In some embodiments, the linker is 64 amino acids in length. In some embodiments, the linker comprises the amino acid sequence SGGSSGGSSGSETPGTSESATPESSGGSSGGSSGGSSGGSSGGSSGSETPGTSESATPESSGGS SGGS (SEQ ID NO: 687). In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAP GTSTEPSEGSAPGTSESATPESGPGSEPATS (SEQ ID NO: 688).

Some aspects of the disclosure provide fusion proteins comprising a Cas9 domain and an adenosine deaminase. Exemplary fusion proteins include, without limitation, the following fusion proteins (for the purposes of clarity, the adenosine deaminase domain is shown in Bold; mutations of the ecTadA deaminase domain are shown in Bold underlining; the XTEN linker is shown in italics; the UGI/AAG/EndoV domains are shown in Bold italics; and NLS is shown in underlined italics):

```
ecTadA(wt)-XTEN-nCas9-NLS:
                                                        (SEQ ID NO: 11)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGSETPGTSESATPESDKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH
```

-continued

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108N)-XTEN-nCas9-NLS: (mammalian construct, active on DNA, A to G editing):

(SEQ ID NO: 12)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARN̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108G)-XTEN-nCas9-NLS: (mammalian construct, active on DNA, A to G editing):

(SEQ ID NO: 13)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARG̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108V)-XTEN-nCas9-NLS: (mammalian construct, active on DNA, A to G editing):

(SEQ ID NO: 14)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108N)-XTEN-nCas9-UGI-NLS (BE3 analog of A to G editor):
(SEQ ID NO: 15)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGS*PKKKRKV*

-continued ecTadA(D108G)-XTEN-nCas9-UGI-NLS (BE3 analog of A to G editor):
(SEQ ID NO: 16)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD<em>SGSETPGTSESATPES</em>DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML* SGGS<u>PKKKRKV</u> ecTadA(D108V)-XTEN-nCas9-UGI-NLS (BE3 analog of A to G editor):
(SEQ ID NO: 17)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD<em>SGSETPGTSESATPES</em>DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*TNLSDIIEKETGKQLVIQESILMLPEEVEEVIGNKPESDILVHT*
*AYDESTDENVMLLTSDAPEYKPWALVIQDSNGENKIKML* SGGS<u>PKKKRKV</u> ecTadA(D108N)-XTEN-dCas9-UGI-NLS (mammalian cells, BE2 analog of A to G
editor):

(SEQ ID NO: 18)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARN̲AKTGAAGSLMDVLHHPGMNHRVEITEGILADECAALLSDFFRMRRQEIKA
QKKAQSSTD*SGSETPGTSESATPES*<u>DKKYSIGLAIGTNSVGWAVITDEYKVPSKKFKV</u>
<u>LGNTDRHSIKKNLIGALLFDSGETAEATRLKRTARRRYTRRKNRICYLQEIFSNEMAK</u>
<u>VDDSFFHRLEESFLVEEDKKHERHPIFGNIVDEVAYHEKYPTIYHLRKKLVDSTDKAD</u>
<u>LRLIYLALAHMIKFRGHFLIEGDLNPDNSDVDKLFIQLVQTYNQLFEENPINASGVDA</u>
<u>KAILSARLSKSRRLENLIAQLPGEKKNGLFGNLIALSLGLTPNFKSNFDLAEDAKLQLS</u>
<u>KDTYDDDLDNLLAQIGDQYADLFLAAKNLSDAILLSDILRVNTEITKAPLSASMIKRY</u>
<u>DEHHQDLTLLKALVRQQLPEKYKEIFFDQSKNGYAGYIDGGASQEEFYKFIKPILEK</u>
<u>MDGTEELLVKLNREDLLRKQRTFDNGSIPHQIHLGELHAILRRQEDFYPFLKDNREKI</u>
<u>EKILTFRIPYYVGPLARGNSRFAWMTRKSEETITPWNFEEVVDKGASAQSFIERMTNF</u>
<u>DKNLPNEKVLPKHSLLYEYFTVYNELTKVKYVTEGMRKPAFLSGEQKKAIVDLLFK</u>
<u>TNRKVTVKQLKEDYFKKIECFDSVEISGVEDRFNASLGTYHDLLKIIKDKDFLDNEEN</u>
<u>EDILEDIVLTLTLFEDREMIEERLKTYAHLFDDKVMKQLKRRRYTGWGRLSRKLINGI</u>
<u>RDKQSGKTILDFLKSDGFANRNFMQLIHDDSLTFKEDIQKAQVSGQGDSLHEHIANL</u>
<u>AGSPAIKKGILQTVKVVDELVKVMGRHKPENIVIEMARENQTTQKGQKNSRERMKR</u>
<u>IEEGIKELGSQILKEHPVENTQLQNEKLYLYYLQNGRDMYVDQELDINRLSDYDVDA</u>
<u>IVPQSFLKDDSIDNKVLTRSDKNRGKSDNVPSEEVVKKMKNYWRQLLNAKLITQRK</u>
<u>FDNLTKAERGGLSELDKAGFIKRQLVETRQITKHVAQILDSRMNTKYDENDKLIREV</u>

-continued

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGS PKKKRKV ecTadA(D108G)-XTEN-dCas9-UGI-NLS (mammalian cells, BE2 analog of A to G editor):

(SEQ ID NO: 19)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGS PKKKRKV

-continued ecTadA(D108V)-XTEN-dCas9-UGI-NLS (mammalian cells, BE2 analog of A to G editor):

(SEQ ID NO: 20)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>V</u>AKTGAAGSLMDVLHHPGMNHRVEITEGILADECAALLSDFFRMRRQEIKA

QKKAQSSTD*SGSETPGTSESATPES*<u>DKKYSIGLAIGTNSVGWAVITDEYKVPSKKFKV</u>

<u>LGNTDRHSIKKNLIGALLFDSGETAEATRLKRTARRRYTRRKNRICYLQEIFSNEMAK</u>

<u>VDDSFFHRLEESFLVEEDKKHERHPIFGNIVDEVAYHEKYPTIYHLRKKLVDSTDKAD</u>

<u>LRLIYLALAHMIKFRGHFLIEGDLNPDNSDVDKLFIQLVQTYNQLFEENPINASGVDA</u>

<u>KAILSARLSKSRRLENLIAQLPGEKKNGLFGNLIALSLGLTPNFKSNFDLAEDAKLQLS</u>

<u>KDTYDDDLDNLLAQIGDQYADLFLAAKNLSDAILLSDILRVNTEITKAPLSASMIKRY</u>

<u>DEHHQDLTLLKALVRQQLPEKYKEIFFDQSKNGYAGYIDGGASQEEFYKFIKPILEK</u>

<u>MDGTEELLVKLNREDLLRKQRTFDNGSIPHQIHLGELHAILRRQEDFYPFLKDNREKI</u>

<u>EKILTFRIPYYVGPLARGNSRFAWMTRKSEETITPWNFEEVVDKGASAQSFIERMTNF</u>

<u>DKNLPNEKVLPKHSLLYEYFTVYNELTKVKYVTEGMRKPAFLSGEQKKAIVDLLFK</u>

<u>TNRKVTVKQLKEDYFKKIECFDSVEISGVEDRFNASLGTYHDLLKIIKDKDFLDNEEN</u>

<u>EDILEDIVLTLTLFEDREMIEERLKTYAHLFDDKVMKQLKRRRYTGWGRLSRKLINGI</u>

<u>RDKQSGKTILDFLKSDGFANRNFMQLIHDDSLTFKEDIQKAQVSGQGDSLHEHIANL</u>

<u>AGSPAIKKGILQTVKVVDELVKVMGRHKPENIVIEMARENQTTQKGQKNSRERMKR</u>

<u>IEEGIKELGSQILKEHPVENTQLQNEKLYLYYLQNGRDMYVDQELDINRLSDYDVDA</u>

<u>IVPQSFLKDDSIDNKVLTRSDKNRGKSDNVPSEEVVKKMKNYWRQLLNAKLITQRK</u>

<u>FDNLTKAERGGLSELDKAGFIKRQLVETRQITKHVAQILDSRMNTKYDENDKLIREV</u>

<u>KVITLKSKLVSDFRKDFQFYKVREINNYHHAHDAYLNAVVGTALIKKYPKLESEFVY</u>

<u>GDYKVYDVRKMIAKSEQEIGKATAKYFFYSNIMNFFKTEITLANGEIRKRPLIETNGE</u>

<u>TGEIVWDKGRDFATVRKVLSMPQVNIVKKTEVQTGGFSKESILPKRNSDKLIARKKD</u>

<u>WDPKKYGGFDSPTVAYSVLVVAKVEKGKSKKLKSVKELLGITIMERSSFEKNPIDFL</u>

<u>EAKGYKEVKKDLIIKLPKYSLFELENGRKRMLASAGELQKGNELALPSKYVNFLYLA</u>

<u>SHYEKLKGSPEDNEQKQLFVEQHKHYLDEIIEQISEFSKRVILADANLDKVLSAYNKH</u>

<u>RDKPIREQAENIIHLFTLTNLGAPAAFKYFDTTIDRKRYTSTKEVLDATLIHQSITGLYE</u>

<u>TRIDLSQLGGD</u>SGGS*TNLSDIIEKETGKQLVIQESILMLPEEVEEVIGNKPESDILVHT*

*AYDESTDENVMLLTSDAPEYKPWALVIQDSNGENKIKML*SGGS<u>PKKKRKV</u> ecTadA(D108N)-XTEN-nCas9-AAG(E125Q)-NLS-cat. alkyladenosine glycosylase:

(SEQ ID NO: 21)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>N</u>AKTGAAGSLMDVLHHPGMNHRVEITEGILADECAALLSDFFRMRRQEIKA

QKKAQSSTD*SGSETPGTSESATPES*<u>DKKYSIGLAIGTNSVGWAVITDEYKVPSKKFKV</u>

<u>LGNTDRHSIKKNLIGALLFDSGETAEATRLKRTARRRYTRRKNRICYLQEIFSNEMAK</u>

<u>VDDSFFHRLEESFLVEEDKKHERHPIFGNIVDEVAYHEKYPTIYHLRKKLVDSTDKAD</u>

<u>LRLIYLALAHMIKFRGHFLIEGDLNPDNSDVDKLFIQLVQTYNQLFEENPINASGVDA</u>

<u>KAILSARLSKSRRLENLIAQLPGEKKNGLFGNLIALSLGLTPNFKSNFDLAEDAKLQLS</u>

<u>KDTYDDDLDNLLAQIGDQYADLFLAAKNLSDAILLSDILRVNTEITKAPLSASMIKRY</u>

-continued

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*KGHLTRLGLEFFDQPAVPLARAFLGQVLVRRLPNGTELRGRI*

*VETQAYLGPEDEAAHSRGGRQTPRNRGMFMKPGTLYVYIIYGMYFCMNISSQGDGA*

*CVLLRALEPLEGLETMRQLRSTLRKGTASRVLKDREICSGPSKLCQALAINKSFDQR*

*DLAQDEAVWIERGPLEPSEPAVVAAARVGVGHAGEWARKPLRFYVRGSPWVSVVD*

*RVAEQDTQA*SGGS<u>PKKKRKV</u> ecTadA(D108G)-XTEN-nCas9-AAG(E125Q)-NLS-cat. alkyladenosine glycosylase:
(SEQ ID NO: 22)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

AR<u>G</u>AKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

-continued

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSKGHLTRLGIEFFDQPAVPIARAFLGQVLVRRLPNGTELRGRI

VETQAYLGPEDEAAHSRGGRQTPRNRGMFMKPGTLYVYIIYGMYFCMNISSQGDGA

CVLLRALEPLEGLETMRQLRSTLRKGTASRVLKDRELCSGPSKLCQALAINKSFDQR

DLAQDEAVWLERGPLEPSEPAVVAAARVGVGHAGEWARKPLRFYVRGSPWVSVVD

RVAEQDTQASGGS<u>PKKKRKV</u> ecTadA(D108V)-XTEN-nCas9-AAG(E125Q)-NLS-cat. alkyladenosine glycosylase:
(SEQ ID NO: 23)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

-continued

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*KGHLTRLGLEFFDQPAVPLARAFLGQVLVRRLPNGTELRGRI*

*VETQAYLGPEDEAAHSRGGRQTPRNRGMFMKPGTLYVYIIYGMYFCMNISSQGDGA*

*CVLLRALEPIEGLETMRQLRSTLRKGTASRVLKDRELCSGPSKLCQALAINKSFDQR*

*DLAQDEAVWLERGPLEPSEPAVVAAARVGVHAGEWARKPIRFYVRGSPWVSVVD*

*RVAEQDTQA*SGGS<u>PKKKRKV</u> ecTadA(D108N)-XTEN-nCas9-EndoV(D35A)-NL5: contains cat. endonuclease V:
(SEQ ID NO: 24)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*DLASLRAQQIELASSVIREDRLDKPPDLIAGAAVGFEQGGEV*

*TRAAMVLLKYPSLELVEYKVARIATTMPYIPGFLSFREYPALLAAWEMLSQKPDLVF*

*VDGHGISHPRRLGVASHFGLLVDVPTIGVAKKRLCGKFEPLSSEPGALAPLMDKGEQ*

*LAWVWRSKARCNPLFIATGHRVSVDSALAWVQRCMKGYRLPEPTRWA*D*AVASERPA*

*FVRYTANQP*SGGS<u>PKKKRKV</u>

-continued ecTadA(D108G)-XTEN-nCas9-EndoV (D35A)-NLS: contains cat. endonuclease V:
(SEQ ID NO: 25)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS_DLASLRAQQIELASSVIREDRLDKDPPDLIAGAAVGFEQGGEV_

_TRAAMVLLKYPSLELVEYKVARIATTMPYIPGFLSFREYPALLAAWEMLSQKPDLVF_

_VDGHGISHPR_R_LGVASHFGLLVDVPTIGVAKKRLCGKFEPLSSEPGALAPLMDKGEQ_

_LAWVWRSKARCNPLFIATGHRVSVDSALAWV_Q_RCMKGYRLPEPTRWADAVASERPA_

_FVRYTANQP_SGGS_PKKKRKV_ ecTadA(D108V)-XTEN-nCas9-EndoV(D35A)-NLS: contains cat. endonuclease V:
(SEQ ID NO: 26)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

-continued

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*DLASLRAQQIELASSVIREDRLDKDPPDLIAGAAVGFEQGGEV*

*TRAAMVLLKYPSLELVEYKVARIATTMPYIPGFLSFREYPALLAAWEMLSQKPDLVF*

*VDGHGISHPRRLGVASHFGLIVDVPTIGVAKKRLCGKFEPISSEPGALAPLMDKGEQ*

*LAWVWRSKARCNPLFIATGHRVSVDS*ALAWVQRCMKGYRLPEPTRWADAVASERPA

FVRYTANQPSGGS PKKKRKV

Variant resulting from first round of evolution (in bacteria) ecTadA
(H8Y_D108N_N127S)-XTEN-dCas9:

(SEQ ID NO: 27)

MSEVEFSYEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMSHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

-continued

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD

Enriched variants from second round of evolution (in bacteria) ecTadA
(H8Y_D108N_N127S_E155X)-XTEN-dCas9; X = D, G or V:
(SEQ ID NO: 28)

MSEVEFSYEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMSHRVEITEGILADECAALLSDFFRMRRQXIKA

QKKAQSSTDSGSETPGTSESATPESDKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD ecTadA*-XTEN-nCas9-GGS-DNA repair inhibitor-GGS-NLS (Inhibitor = UGI, AAG*E125Q or EndoV*D35A)
pNMG-160: ecTadA(D108N)-XTEN-nCas9-GGS-AAG*(EI25Q)-GGS-NLS
(SEQ ID NO: 387)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDGGS_KGHLTRLGLEFFDQPAVPLARFLGQVLVRRIPNGTELRGRIV_

_ETQAYLGPEDEAAHSRGGRQTPRNRGMFMKPGTLYVIIYGMYFCMNISSQGDGAC_

_VLLRALEPLEGLETMRQLRSTLRKGTASRVLKDREICSGPSKLCQALAINKSFDQRD_

_LAQDEAVWLERGPLEPSEPAVVAAARVGVGHAGEWARKPLRFYVRGSPWVSVVDR_

_VAEQDTQA_GGS_PKKKRKV_ pNMG-161: ecTadA(D108N)-XTEN-nCas9-GGS-EndoV*(D35A)-GGS-NLS
(SEQ ID NO: 388)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDGGSDLASLRAQQIELASSVIREDRLKDPPDLIAGAAVGFEQGGEVT

RAAMVLLKYPSLELVEYKVARIATTMPYIPGFLSFREYPALLAAWEMLSQKPDLVFV

DGHGISHPRRLGVASHFGLLVDVPTIGVAKKRLCGKFEPLSSEPGALAPLMDKGEQL

AWVWRSKARCNPLFIATGHRVSVDSALAWVQRCMKGYRIPEPTRWADAVASERPA

_FVRYTANQP_GGS PKKKRKV

```
pNMG-371: ecTadA(L84F_A106V_D108N_H123Y_D147Y_E155V_I156F)-SGGS-
SGGS-XTEN-SGGS-SGGS-
ecTadA(L84F_A106V_D108N_H123Y_D147Y_E155V_I156F)-SGGS-SGGS-XTEN-
SGGS-SGGS-nCas9-SGGS-NLS
```
(SEQ ID NO: 440)

SEVEFSHEYWMRHALTLAKRAWDEREVPVGAVLVHNNRVIGEGWNRPIGRHD

PTAHAEIMALRQGGLVMQNYRLIDATLYVTFEPCVMCAGAMIHSRIGRVVFGV

RNAKTGAAGSLMDVLHYPGMNHRVEITEGILADECAALLSYFFRMRRQVFKAQ

KKAQSSTD_SGGSSGGSSGSETPGTSESATPESSGGSSGGSS_EVEFSHEYWMRHALTL

AKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHY

PGMNHRVEITEGILADECAALLSYFFRMRRQVFKAQKKAQSSTD_SGGSSGGS_ _SGS_

_ETPGTSESATPESSGGSSGGS_DKKYSIGLAIGTNSVGWAVITDEYKVPSKKFKVLGNT

DRHSIKKNLIGALLFDSGETAEATRLKRTARRRYTRRKNRICYLQEIFSNEMAKVDDS
FFHRLEESFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASGVDAKAIL
SARLSKSRRLENLIAQLPGEKKNGLFGNLIALSLGLTPNFKSNFDLAEDAKLQLSKDT
YDDDLDNLLAQIGDQYADLFLAAKNLSDAILLSDILRVNTEITKAPLSASMIKRYDEH
HQDLTLLKALVRQQLPEKYKEIFFDQSKNGYAGYIDGGASQEEFYKFIKPILEKMDG
TEELLVKLNREDLLRKQRTFDNGSIPHQIHLGELHAILRRQEDFYPFLKDNREKIEKIL
TFRIPYYVGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDLLFKTNRK
VTVKQLKEDYFKKIECFDSVEISGVEDRFNASLGTYHDLLKIIKDKDFLDNEENEDILE
DIVLTLTLFEDREMIEERLKTYAHLFDDKVMKQLKRRRYTGWGRLSRKLINGIRDKQ
SGKTILDFLKSDGFANRNFMQLIHDDSLTFKEDIQKAQVSGQGDSLHEHIANLAGSPA
IKKGILQTVKVVDELVKVMGRHKPENIVIEMARENQTTQKGQKNSRERMKRIEEGIK
ELGSQILKEHPVENTQLQNEKLYLYYLQNGRDMYVDQELDINRLSDYDVDHIVPQSF
LKDDSIDNKVLTRSDKNRGKSDNVPSEEVVKKMKNYWRQLLNAKLITQRKFDNLTK
AERGGLSELDKAGFIKRQLVETRQITKHVAQILDSRMNTKYDENDKLIREVKVITLKS
KLVSDFRKDFQFYKVREINNYHHAHDAYLNAVVGTALIKKYPKLESEFVYGDYKVY
DVRKMIAKSEQEIGKATAKYFFYSNIMNFFKTEITLANGEIRKRPLIETNGETGEIVWD
KGRDFATVRKVLSMPQVNIVKKTEVQTGGFSKESILPKRNSDKLIARKKDWDPKKY
GGFDSPTVAYSVLVVAKVEKGKSKKLKSVKELLGITIMERSSFEKNPIDFLEAKGYKE
VKKDLIIKLPKYSLFELENGRKRMLASAGELQKGNELALPSKYVNFLYLASHYEKLK
GSPEDNEQKQLFVEQHKHYLDEIIEQISEFSKRVILADANLDKVLSAYNKHRDKPIRE
QAENIIHLFTLTNLGAPAAFKYFDTTIDRKRYTSTKEVLDATLIHQSITGLYETRIDLSQ
LGGDSGGSPKKKRKV pNMG-616 amino acid sequence: ecTadA(*wild type*)-(SGGS)2-XTEN-(SGGS)2-ecTadA(*W23L_H36L_P48A_R51L_L84F_A106V_D108N_H123Y_S146C_D147Y_R152P_E155V_I156F_K157N*)-(SGGS)2-XTEN-(SGGS)2_nCas9_SGGS_NLS (SEQ ID NO: 691)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTD*SGGSSGGSSGSETPGTSESATPESS*GGSSGGSSEVEFSHEYWMRHALT
LAKRALDEREVPVGAVLVLNNRVIGEGWNRAIGLHDPTAHAEIMALRQGGLV
MQNYRLIDATLYVTFEPCVMCAGAMIHSRIGRVVFGVRNAKTGAAGSLMDVLH
YPGMNHRVEITEGILADECAALLCYFFRMPRQVFNAQKKAQSSTD*SGGSSGGSS*
*GSETPGTSESATPESS*GGSSGGSDKKYSIGLAIGTNSVGWAVITDEYKVPSKKFKVLGN
TDRHSIKKNLIGALLFDSGETAEATRLKRTARRRYTRRKNRICYLQEIFSNEMAKVDD
SFFHRLEESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINASGVDAKAI
LSARLSKSRRLENLIAQLPGEKKNGLFGNLIALSLGLTPNFKSNFDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGD*SGGS*<u>PKKKRKV</u> pNMG-624 amino acid sequence: ecTadA$_{(wild\ type)}$-32 a.a. linker-ecTadA$_{(W23R\_H36L\_P48A\_R51L\_L84F\_A106V\_D108N\_H123Y\_S146C\_D147Y\_R152P\_E155V\_I156F\_K157N)}$-24 a.a. linker_nCas9_SGGS_NLS (SEQ ID NO: 692)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD_SGGSSGGSSGSETPGTSESATPESSGGSSGGS_SEVEFSHEYWMRHALTL

AKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD_SGGSSGGSSGS_

_ETPGTSESATPES_<u>DKKYSIGLAIGTNSVGWAVITDEYKVPSKKFKVLGNTDRHSIKKNL</u>

<u>IGALLFDSGETAEATRLKRTARRRYTRRKNRICYLQEIFSNEMAKVDDSFFHRLEESF</u>

<u>LVEEDKKHERHPIFGNIVDEVAYHEKYPTIYHLRKKLVDSTDKADLRLIYLALAHMI</u>

<u>KFRGHFLIEGDLNPDNSDVDKLFIQLVQTYNQLFEENPINASGVDAKAILSARLSKSR</u>

<u>RLENLIAQLPGEKKNGLFGNLIALSLGLTPNFKSNFDLAEDAKLQLSKDTYDDDLDN</u>

<u>LLAQIGDQYADLFLAAKNLSDAILLSDILRVNTEITKAPLSASMIKRYDEHHQDLTLL</u>

<u>KALVRQQLPEKYKEIFFDQSKNGYAGYIDGGASQEEFYKFIKPILEKMDGTEELLVKL</u>

<u>NREDLLRKQRTFDNGSIPHQIHLGELHAILRRQEDFYPFLKDNREKIEKILTFRIPYYV</u>

<u>GPLARGNSRFAWMTRKSEETITPWNFEEVVDKGASAQSFIERMTNFDKNLPNEKVLP</u>

<u>KHSLLYEYFTVYNELTKVKYVTEGMRKPAFLSGEQKKAIVDLLFKTNRKVTVKQLK</u>

<u>EDYFKKIECFDSVETSGVEDRFNASLGTYHDLLKIIKDKDFLDNEENEDILEDIVLTLTL</u>

<u>FEDREMIEERLKTYAHLFDDKVMKQLKRRRYTGWGRLSRKLINGIRDKQSGKTILDF</u>

<u>LKSDGFANRNFMQLIHDDSLTFKEDIQKAQVSGQGDSLHEHIANLAGSPAIKKGILQT</u>

<u>VKVVDELVKVMGRHKPENIVIEMARENQTTQKGQKNSRERMKRIEEGIKELGSQILK</u>

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRK*V pNMG-476 amino acid sequence (evolution #3 hetero dimer, wt TadA + TadA
evo #3 mutations): ecTadA(wild-type)-(SGGS)2-XTEN-(SGGS)2-
ecTadA(L84F_A106V_D108N_H123Y_D147Y_E155V_I156F)-(SGGS)2-XTEN-
(SGGS)2_nCas9_SGGS_NLS (SEQ ID NO: 693)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVHNNRVIGEGWNRPIGRHDPTAHAEIMALRQGGLV

MQNYRLIDATLYVTFEPCVMCAGAMIHSRIGRVVFGVRNAKTGAAGSLMDVLH

YPGMNHRVEITEGILADECAALLSYFFRMRRQVFKAQKKAQSSTDSGGSSGGSS

GSETPGTSESATPESSGGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-477 amino acid sequence: ecTadA$_{(wild-type)}$-(SGGS)2-XTEN-(SGGS)2-ecTadA$_{(H36L\_R51L\_L84F\_A106V\_D108N\_H123Y\_S146C\_D147Y\_E155V\_I156F\_K157N)}$-(SGGS)2-XTEN-(SGGS)2_nCas9_SGGS_NLS (SEQ ID NO: 694)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRPIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-558 amino acid sequence: ecTadA$_{(wild\ type)}$-32 a.a. linker-
ecTadA$_{(H36L\_R51L\_L84F\_A106V\_D108N\_H123Y\_S146C\_D147Y\_E155V\_I156F\_K157N)}$-24 a.a.
linker_nCas9_SGGS_NLS (SEQ ID NO: 695)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGSSGSETPGTSESATPESSGGSSGGSSEVEFSHEYWMRHALTL

AKRAWDEREVPVGAVLVLNNRVIGEGWNRPIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMRRQVFNAQKKAQSSTDSGGSSGGSSGS

ETPGTSESATPES<u>DKKYSIGLAIGTNSVGWAVITDEYKVPSKKFKVLGNTDRHSIKKNL</u>

<u>IGALLFDSGETAEATRLKRTARRRYTRRKNRICYLQEIFSNEMAKVDDSFFHRLEESF</u>

<u>LVEEDKKHERHPIFGNIVDEVAYHEKYPTIYHLRKKLVDSTDKADLRLIYLALAHMI</u>

<u>KFRGHFLIEGDLNPDNSDVDKLFIQLVQTYNQLFEENPINASGVDAKAILSARLSKSR</u>

<u>RLENLIAQLPGEKKNGLFGNLIALSLGLTPNFKSNFDLAEDAKLQLSKDTYDDDLDN</u>

<u>LLAQIGDQYADLFLAAKNLSDAILLSDILRVNTEITKAPLSASMIKRYDEHHQDLTLL</u>

<u>KALVRQQLPEKYKEIFFDQSKNGYAGYIDGGASQEEFYKFIKPILEKMDGTEELLVKL</u>

<u>NREDLLRKQRTFDNGSIPHQIHLGELHAILRRQEDFYPFLKDNREKIEKILTFRIPYYV</u>

<u>GPLARGNSRFAWMTRKSEETITPWNFEEVVDKGASAQSFIERMTNFDKNLPNEKVLP</u>

<u>KHSLLYEYFTVYNELTKVKYVTEGMRKPAFLSGEQKKAIVDLLFKTNRKVTVKQLK</u>

<u>EDYFKKIECFDSVETSGVEDRFNASLGTYHDLLKIIKDKDFLDNEENEDILEDIVLTLTL</u>

<u>FEDREMIEERLKTYAHLFDDKVMKQLKRRRYTGWGRLSRKLINGIRDKQSGKTILDF</u>

<u>LKSDGFANRNFMQLIHDDSLTFKEDIQKAQVSGQGDSLHEHIANLAGSPAIKKGILQT</u>

<u>VKVVDELVKVMGRHKPENIVIEMARENQTTQKGQKNSRERMKRIEEGIKELGSQILK</u>

<u>EHPVENTQLQNEKLYLYYLQNGRDMYVDQELDINRLSDYDVDHIVPQSFLKDDSID</u>

<u>NKVLTRSDKNRGKSDNVPSEEVVKKMKNYWRQLLNAKLITQRKFDNLTKAERGGL</u>

<u>SELDKAGFIKRQLVETRQITKHVAQILDSRMNTKYDENDKLIREVKVITLKSKLVSDF</u>

<u>RKDFQFYKVREINNYHHAHDAYLNAVVGTALIKKYPKLESEFVYGDYKVYDVRKM</u>

<u>IAKSEQEIGKATAKYFFYSNIMNFFKTEITLANGEIRKRPLIETNGETGEIVWDKGRDF</u>

<u>ATVRKVLSMPQVNIVKKTEVQTGGFSKESILPKRNSDKLIARKKDWDPKKYGGFDSP</u>

<u>TVAYSVLVVAKVEKGKSKKLKSVKELLGITIMERSSFEKNPIDFLEAKGYKEVKKDLI</u>

<u>IKLPKYSLFELENGRKRMLASAGELQKGNELALPSKYVNFLYLASHYEKLKGSPEDN</u>

<u>EQKQLFVEQHKHYLDEIIEQISEFSKRVILADANLDKVLSAYNKHRDKPIREQAENIIH</u>

<u>LFTLTNLGAPAAFKYFDTTIDRKRYTSTKEVLDATLIHQSITGLYETRIDLSQLGGDSG</u>

<u>GS</u><u>*PKKKRKV*</u> pNMG-576 amino acid sequence: ecTadA$_{(wild-type)}$-(SGGS)2-XTEN-(SGGS)2-
eeradA$_{(H36L\_P48S\_R51L\_L84F\_A106V\_D108N\_H123Y\_S146C\_D147Y\_E155V\_I156F\_K157N)}$-(SGGS)2-XTEN-
(SGGS)2_nCas9_GGS_NLS (SEQ ID NO: 696)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPES*SGGSSGGSSEVEFSHEYWMRHALT

LAKRAWDEREVPVGAVLVLNNRVIGEGWNRSIGLHDPTAHAEIMALRQGGLV

-continued

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGS<u>DKKYSIGLAIGTNSVGWAVITDEYKVPSKKFKVLGN</u>

<u>TDRHSIKKNLIGALLFDSGETAEATRLKRTARRRYTRRKNRICYLQEIFSNEMAKVDD</u>

<u>SFFHRLEESFLVEEDKKHERHPIFGNIVDEVAYHEKYPTIYHLRKKLVDSTDKADLRL</u>

<u>IYLALAHMIKFRGHFLIEGDLNPDNSDVDKLFIQLVQTYNQLFEENPINASGVDAKAI</u>

<u>LSARLSKSRRLENLIAQLPGEKKNGLFGNLIALSLGLTPNFKSNFDLAEDAKLQLSKD</u>

<u>TYDDDLDNLLAQIGDQYADLFLAAKNLSDAILLSDILRVNTEITKAPLSASMIKRYDE</u>

<u>HHQDLTLLKALVRQQLPEKYKEIFFDQSKNGYAGYIDGGASQEEFYKFIKPILEKMD</u>

<u>GTEELLVKLNREDLLRKQRTFDNGSIPHQIHLGELHAILRRQEDFYPFLKDNREKIEKI</u>

<u>LTFRIPYYVGPLARGNSRFAWMTRKSEETITPWNFEEVVDKGASAQSFIERMTNFDK</u>

<u>NLPNEKVLPKHSLLYEYFTVYNELTKVKYVTEGMRKPAFLSGEQKKAIVDLLFKTNR</u>

<u>KVTVKQLKEDYFKKIECFDSVEISGVEDRFNASLGTYHDLLKIIKDKDFLDNEENEDI</u>

<u>LEDIVLTLTLFEDREMIEERLKTYAHLFDDKVMKQLKRRRYTGWGRLSRKLINGIRD</u>

<u>KQSGKTILDFLKSDGFANRNFMQLIHDDSLTFKEDIQKAQVSGQGDSLHEHIANLAG</u>

<u>SPAIKKGILQTVKVVDELVKVMGRHKPENIVIEMARENQTTQKGQKNSRERMKRIEE</u>

<u>GIKELGSQILKEHPVENTQLQNEKLYLYYLQNGRDMYVDQELDINRLSDYDVDHIVP</u>

<u>QSFLKDDSIDNKVLTRSDKNRGKSDNVPSEEVVKKMKNYWRQLLNAKLITQRKFDN</u>

<u>LTKAERGGLSELDKAGFIKRQLVETRQITKHVAQILDSRMNTKYDENDKLIREVKVIT</u>

<u>LKSKLVSDFRKDFQFYKVREINNYHHAHDAYLNAVVGTALIKKYPKLESEFVYGDY</u>

<u>KVYDVRKMIAKSEQEIGKATAKYFFYSNIMNFFKTEITLANGEIRKRPLIETNGETGEI</u>

<u>VWDKGRDFATVRKVLSMPQVNIVKKTEVQTGGFSKESILPKRNSDKLIARKKDWDP</u>

<u>KKYGGFDSPTVAYSVLVVAKVEKGKSKKLKSVKELLGITIMERSSFEKNPIDFLEAK</u>

<u>GYKEVKKDLIIKLPKYSLFELENGRKRMLASAGELQKGNELALPSKYVNFLYLASHY</u>

<u>EKLKGSPEDNEQKQLFVEQHKHYLDEIIEQISEFSKRVILADANLDKVLSAYNKHRDK</u>

<u>PIREQAENIIHLFTLTNLGAPAAFKYFDTTIDRKRYTSTKEVLDATLIHQSITGLYETRI</u>

<u>DLSQLGGD</u>SGGS*PKKKRKV* pNMG-577 amino acid sequence: ecTadA$_{(wild-type)}$-(SGGS)2-XTEN-(SGGS)2-
ecTadA$_{(H36L\_P48S\_R51L\_L84F\_A106V\_D108N\_H123Y\_S146C\_A142N\_D147Y\_E155V\_I156F\_K157N)}$-(SGGS)2-
XTEN-(SGGS)2_nCas9_GGS_NLS (SEQ ID NO: 697)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRSIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTDSGGSSGGS*S*

*GSETPGTSESATPESS*GGSSGGS<u>DKKYSIGLAIGTNSVGWAVITDEYKVPSKKFKVLGN</u>

<u>TDRHSIKKNLIGALLFDSGETAEATRLKRTARRRYTRRKNRICYLQEIFSNEMAKVDD</u>

<u>SFFHRLEESFLVEEDKKHERHPIFGNIVDEVAYHEKYPTIYHLRKKLVDSTDKADLRL</u>

<u>IYLALAHMIKFRGHFLIEGDLNPDNSDVDKLFIQLVQTYNQLFEENPINASGVDAKAI</u>

```
LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-586 amino acid sequence: ecTadA<sub>(wild-type)</sub>-(SGGS)2-XTEN-(SGGS)2-
ecTadA<sub>(H36L_P48A_R51L_L84F_A106V_D108N_H123Y_S146C_D147Y_E155V_I156F_K157N)</sub>-(SGGS)2-XTEN-
(SGGS)2_nCas9_GGS_NLS
                                                              (SEQ ID NO: 698)
MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI
```

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGD SGGS *PKKKRKV* pNMG-588 amino acid sequence: ecTadA<sub>(wild-type)</sub>-(SGGS)2-XTEN-(SGGS)2-ecTadA<sub>(H36L_P48A_R51L_L84F_A106V_D108N_H123Y_S146C_A142N_D147Y_E155V_I156F_K157N)</sub>-(SGGS)2-XTEN-(SGGS)2_nCas9_GGS_NLS (SEQ ID NO: 699)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

-continued

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-620 amino acid sequence: ecTadA$_{(wild-type)}$-(SGGS)2-XTEN-(SGGS)2-ecTadA$_{(W23R\_H36L\_P48A\_R51L\_L84F\_A106V\_D108N\_H123Y\_S146C\_D147Y\_R152P\_E155V\_I156F\_K157N)}$-(SGGS)2-XTEN-(SGGS)2_nCas9_GGS_NLS (SEQ ID NO: 700)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRARDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-617 amino acid sequence: ecTadA<sub>(wild-type)</sub>-(SGGS)2-XTEN-(SGGS)2-
ecTadA<sub>(W23L_H36L_P48A_R51L_L84F_A106V_D108N_H123Y_A142A_S146C_D147Y_E155V_I156F_K157N)</sub>-
(SGGS)2-XTEN-(SGGS)2_nCas9_GGS_NLS (SEQ ID NO: 701)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTDSGGSSGGS*S*

*GSETPGTSESATPESS*GGSSGGS<u>DKKYSIGLAIGTNSVGWAVITDEYKVPSKKFKVLGN</u>

<u>TDRHSIKKNLIGALLFDSGETAEATRLKRTARRRYTRRKNRICYLQEIFSNEMAKVDD</u>

<u>SFFHRLEESFLVEEDKKHERHPIFGNIVDEVAYHEKYPTIYHLRKKLVDSTDKADLRL</u>

<u>IYLALAHMIKFRGHFLIEGDLNPDNSDVDKLFIQLVQTYNQLFEENPINASGVDAKAI</u>

<u>LSARLSKSRRLENLIAQLPGEKKNGLFGNLIALSLGLTPNFKSNFDLAEDAKLQLSKD</u>

<u>TYDDDLDNLLAQIGDQYADLFLAAKNLSDAILLSDILRVNTEITKAPLSASMIKRYDE</u>

<u>HHQDLTLLKALVRQQLPEKYKEIFFDQSKNGYAGYIDGGASQEEFYKFIKPILEKMD</u>

<u>GTEELLVKLNREDLLRKQRTFDNGSIPHQIHLGELHAILRRQEDFYPFLKDNREKIEKI</u>

<u>LTFRIPYYVGPLARGNSRFAWMTRKSEETITPWNFEEVVDKGASAQSFIERMTNFDK</u>

<u>NLPNEKVLPKHSLLYEYFTVYNELTKVKYVTEGMRKPAFLSGEQKKAIVDLLFKTNR</u>

<u>KVTVKQLKEDYFKKIECFDSVEISGVEDRFNASLGTYHDLLKIIKDKDFLDNEENEDI</u>

<u>LEDIVLTLTLFEDREMIEERLKTYAHLFDDKVMKQLKRRRYTGWGRLSRKLINGIRD</u>

<u>KQSGKTILDFLKSDGFANRNFMQLIHDDSLTFKEDIQKAQVSGQGDSLHEHIANLAG</u>

<u>SPAIKKGILQTVKVVDELVKVMGRHKPENIVIEMARENQTTQKGQKNSRERMKRIEE</u>

<u>GIKELGSQILKEHPVENTQLQNEKLYLYYLQNGRDMYVDQELDINRLSDYDVDHIVP</u>

<u>QSFLKDDSIDNKVLTRSDKNRGKSDNVPSEEVVKKMKNYWRQLLNAKLITQRKFDN</u>

<u>LTKAERGGLSELDKAGFIKRQLVETRQITKHVAQILDSRMNTKYDENDKLIREVKVIT</u>

<u>LKSKLVSDFRKDFQFYKVREINNYHHAHDAYLNAVVGTALIKKYPKLESEFVYGDY</u>

<u>KVYDVRKMIAKSEQEIGKATAKYFFYSNIMNFFKTEITLANGEIRKRPLIETNGETGEI</u>

<u>VWDKGRDFATVRKVLSMPQVNIVKKTEVQTGGFSKESILPKRNSDKLIARKKDWDP</u>

<u>KKYGGFDSPTVAYSVLVVAKVEKGKSKKLKSVKELLGITIMERSSFEKNPIDFLEAK</u>

<u>GYKEVKKDLIIKLPKYSLFELENGRKRMLASAGELQKGNELALPSKYVNFLYLASHY</u>

<u>EKLKGSPEDNEQKQLFVEQHKHYLDEIIEQISEFSKRVILADANLDKVLSAYNKHRDK</u>

<u>PIREQAENIIHLFTLTNLGAPAAFKYFDTTIDRKRYTSTKEVLDATLIHQSITGLYETRI</u>

<u>DLSQLGGDSGGS</u>*PKKKRKV* pNMG-618 amino acid sequence: ecTadA<sub>(wild-type)</sub>-(SGGS)2-XTEN-(SGGS)2-
ecTadA<sub>(W23L_H36L_P48A_R51L_L84F_A106V_D108N_H123Y_A142A_S146C_D147Y_R152P_E155V_I156F_K157N)</sub>-
(SGGS)2-XTEN-(SGGS)2_nCas9_GGS_NLS (SEQ ID NO: 702)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGS SGSETPGTSESATPESSGGSSGGS*SEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMPRQVFNAQKKAQSSTD*SGGSSGGSS*

*GSETPGTSESATPESSGGSSGGS*DKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGD*SGGS PKKKRKV* pNMG-620 amino acid sequence: ecTadA<sub>(wild-type)</sub>-(SGGS)2-XTEN-(SGGS)2-
ecTadA<sub>(W23R_H36L_P48A_R51L_L84F_A106V_D108N_H123Y_S146C_D147Y_R152P_E155V_I156F_K157N)</sub>-
(SGGS)2-XTEN-(SGGS)2_nCas9_GGS_NLS (SEQ ID NO: 703)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGS SGSETPGTSESATPESSGGSSGGS*SEVEFSHEYWMRHALT

LAKRARDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTD*SGGSSGGSS*

*GSETPGTSESATPESSGGSSGGS*DKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-621 amino acid sequence: ecTadA<sub>(wild-type)</sub>-32 a.a. linker-
ecTadA<sub>(H36L_P48A_R51L_L84F_A106V_D108N_H123Y_S146C_D147Y_R152P_E155V_I156F_K157N)</sub>-24 a.a.
linker_nCas9_GGS_NLS (SEQ ID NO: 704)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALTL

AKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQnKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-622 amino acid sequence: ecTadA(wild-type)-32 a.a. linker-
ecTadA(H36L_P48A_R51L_L84F_A106V_D108N_H123Y_A142N_S146C_D147Y_R152P_E155V_I156F_K157N)-24 a.a.
linker_nCas9_GGS_NLS (SEQ ID NO: 705)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALTL

AKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECNALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-623 amino acid sequence: ecTadA$_{(wild-type)}$-32 a.a. linker-ecTadA$_{(W23L\_H36L\_P48A\_R51L\_L84F\_A106V\_D108N\_H123Y\_S146C\_D147Y\_R152P\_E155V\_I156F\_K157N)}$-24 a.a. linker_nCas9_GGS_NLS (SEQ ID NO: 706)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALTL

AKRALDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVETSGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQnKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

-continued

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV*

In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 11-28, 387, 388, 440, 691-706, or to any of the fusion proteins provided herein. In some embodiments, the fusion protein comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 11-28, 387, 388, 440, 691-706, or any of the fusion proteins provided herein. In some embodiments, the fusion protein comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, at least 170, at least 200, at least 300, at least 400, at least 500, at least 600, at least 700, at least 800, at least 900, at least 1000, at least 1100, at least 1200, at least 1300, at least 1400, at least 1500, at least 1600, at least 1700, at least 1750, or at least 1800 identical contiguous amino acid residues as compared to any one of the amino acid sequences set forth in SEQ ID NOs: 11-28, 387, 388, 440, 691-706, or any of the fusion proteins provided herein.

Nucleic Acid Programmable DNA Binding Protein (napDNAbp) Complexes with Guide Nucleic Acids Some aspects of this disclosure provide complexes comprising any of the fusion proteins provided herein, and a guide nucleic acid bound to napDNAbp of the fusion protein. Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder. In some embodiments, the guide nucleic acid (e.g., guide RNA) is complementary to a sequence associated with a disease or disorder having a mutation in a gene selected from the genes disclosed in any one of Tables 1 and 2.

Methods of Using Fusion Proteins Comprising an Adenosine Deaminase and a Nucleic Acid Programmable DNA Binding Protein (napDNAbp) Domain Some aspects of this disclosure provide methods of using the fusion proteins, or complexes comprising a guide nucleic acid (e.g., gRNA) and a nucleobase editor provided herein. For example, some aspects of this disclosure provide methods comprising contacting a DNA, or RNA molecule with any of the fusion proteins provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder. In some embodiments, the disease or disorder is phenylketonuria, von Willebrand disease (vWD), a neoplastic disease associated with a mutant PTEN or BRCA1, or Li-Fraumeni syndrome. A list of exemplary diseases and disorders that may be treated using the nucleobase editors provided herein is shown in Table 1. Table 1 includes the target gene, the mutation to be corrected, the related disease and the nucleotide sequence of the associated protospacer and PAM.

TABLE 1

List of exemplary diseases that may be treated using the
nucleobase editors provided herein. The A to be edited
in the protospacer is indicated by underlining and the
PAM is indicated in bold.

| Target Gene | Mutation | ATCC Cell Line | Disease | Protospacer and PAM |
|---|---|---|---|---|
| PTEN | Cys136Tyr | HTB-128 | Cancer Predisposition | TATATGCATATTTATTACATCGG (SEQ ID NO: 85) |
| PTEN | Arg233Ter | HTB-13 | Cancer Predisposition | CCGTCATGTGGGTCCTGAATGG (SEQ ID NO: 86) |
| TP53 | Glu258Lys | HTB-65 | Cancer Predisposition | ACACTGAAAGACTCCAGGTCAGG (SEQ ID NO: 87) |
| BRCA1 | Gly1738Arg | NA | Cancer Predisposition | GTCAGAAGAGATGTGGTCAATGG (SEQ ID NO: 88) |
| BRCA1 | 4097-1G > A | NA | Cancer Predisposition | TTTAAAGTGAAGCAGCATCTGGG (SEQ ID NO: 89); ATTTAAAGTGAAGCAGCATCTGG (SEQ ID NO: 90) |
| PAH | Thr380Met | NA | Phenylketonuria | ACTCCATGACAGTGTAATTTTGG (SEQ ID NO: 91) |
| VWF | Ser1285Phe | NA | von Willebrand (Hemophilia) | GCCTGGAGAAGCCATCCAGCAGG (SEQ ID NO: 92) |
| VWF | Arg2535Ter | NA | von Willebrand (Hemophilia) | CTCAGACACACTCATTGATGAGG (SEQ ID NO: 93) |
| TP53 | Arg175His | HCC1395 | Li-Fraumeni syndrome | GAGGCACTGCCCCCACCATGAGCG (SEQ ID NO: 94) |

Some embodiments provide methods for using the DNA editing fusion proteins provided herein. In some embodiments, the fusion protein is used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain can be used to correct any single point G to A or C to T mutation. In the first case, deamination of the mutant A to I corrects the mutation, and in the latter case, deamination of the A that is base-paired with the mutant T, followed by a round of replication, corrects the mutation. Exemplary point mutations that can be corrected are listed in Tables 1 and 2.

The successful correction of point mutations in disease-associated genes and alleles opens up new strategies for gene correction with applications in therapeutics and basic research. Site-specific single-base modification systems like the disclosed fusions of a nucleic acid programmable DNA binding protein and an adenosine deaminase domain also have applications in "reverse" gene therapy, where certain gene functions are purposely suppressed or abolished. In these cases, site-specifically mutating residues that lead to inactivating mutations in a protein, or mutations that inhibit function of the protein can be used to abolish or inhibit protein function in vitro, ex vivo, or in vivo.

The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., a cancer associated with a point mutation as described above, an effective amount of an adenosine deaminase fusion protein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Aase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent *porphyria*; deficiency of Acyl-CoA dehydrogenase family, member 9; Adams-Oliver syndrome 5 and 6; Adenine phosphoribosyltransferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-1-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, IIA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TAR-DBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; Atrophia bulborum hereditaria; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis *laxa* type IA and 1B; Autosomal recessive hypohidrotic ectodermal dysplasia syndrome; Ectodermal dysplasia 11b; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and *epicanthus inversus*; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glucosuria, and nuclear diffuse nonprogressive; Catecholaminergic polymorphic ventricular tachycardia; Caudal regression syndrome; Cd8 deficiency, familial; Central core disease; Centromeric instability of chromosomes 1,9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facio-skeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; *Chondrodysplasia* Blomstrand type; *Chondrodysplasia punctata* 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A; Coenzyme Q10 deficiency, primary 1, 4, and 7; Coffin Siris/Intellectual Disability; Coffin-Lowry syndrome; Cohen syndrome; Cold-induced sweating syndrome 1; COLE-CARPENTER SYNDROME 2; Combined cellular and humoral immune defects with granulomas; Combined d-2- and 1-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional c1 inhibitor; Complement factor B deficiency; Cone monochromatism; Cone-rod dystrophy 2 and 6; Cone-rod dystrophy amelogenesis imperfecta; Congenital adrenal hyperplasia and Congenital adrenal hypoplasia, X-linked; Congenital amegakaryocytic thrombocytopenia; Congenital aniridia; Congenital central hypoventilation; Hirschsprung disease 3; Congenital contractural arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic *porphyria*; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillous atrophy; Congenital muscular dystrophy; Congenital muscular dystrophy due to partial LAMA2 deficiency; Congenital muscular dystrophy-dystroglycanopathy with brain and eye anomalies, types A2, A7, A8, A11, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis *laxa* with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulin-dependent, 20; Diamond-Blackfan anemia 1, 5, 8, and 10; Diarrhea 3 (secretory sodium, congenital, syndromic) and 5 (with tufting enteropathy, congenital); Dicarboxylic amino-aciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 1I, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial *porphyria cutanea tarda*; Familial pulmonary capillary hemangiomatosis; Familial renal glucosuria; Familial renal hypouricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia 1 and 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-biphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Glutathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome;

Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB amd IIA; Hereditary sideroblastic anemia; Hermansky-Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2, 3,7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cb1E complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hyperphosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and *acanthosis nigricans*; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; Iodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris *striata* 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalencephalic leukoencephalopathy with subcortical cysts 1and 2a; Megalencephaly cutis marmorata telangiectatica congenital; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness; Meier-Gorlin syndromes 1and 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, Hedera type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria; Methylmalonic aciduria cb1B type; Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvement) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types 1and 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP deaminase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type 1and type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild *chondrodysplasia*; Osteochondritis dissecans; Osteogenesis imperfecta type 12, type 5, type 7, type 8, type I, type III, with normal sclerae, dominant form, recessive perinatal lethal; *Osteopathia striata* with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1;

Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; *Porphyria cutanea tarda*; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase ⅓ deficiency; Prostate cancer, hereditary, 2; Protan defect; Proteinuria; Finnish congenital nephrotic syndrome; *Proteus* syndrome; Breast adenocarcinoma; Pseudoachondroplastic spondyloepiphyseal dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic *chondrodysplasia punctata* type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantil types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5; Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Partial adenosine deaminase deficiency; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2; Spastic ataxia 5, autosomal recessive, Charlevoix-Saguenay type, 1,10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1; Kniest dysplasia; Stickler syndrome, types 1 (nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, lb; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate *porphyria*; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types land 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weis senbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with steryl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

The instant disclosure provides lists of genes comprising pathogenic G to A or C to T mutations. Such pathogenic G to A or C to T mutations may be corrected using the methods and compositions provided herein, for example by mutating the A to a G, and/or the T to a C, thereby restoring gene function. Table 2 includes exemplary mutations that can be corrected using nucleobase editors provided herein. Table 2 includes the gene symbol, the associated phenotype, the mutation to be corrected and exemplary gRNA sequences which may be used to correct the mutations. The gRNA sequences provided in Table 2 are sequences that encode RNA that can direct Cas9, or any of the base editors provided herin, to a target site. For example, the gRNA sequences provided in Table 2 may be cloned into a gRNA expression vector, such as pFYF to encode a gRNA that targets Cas9, or any of the base editors provided herein, to a target site in order to correct a disease-related mutation. It should be appreciated, however, that additional mutations may be corrected to treat additional diseases associated with a G to A or C to T mutation. Furthermore, additional gRNAs may be designed based on the disclosure and the knowledge in the art, which would be appreciated by the skilled artisan.

TABLE 2

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338761 | SEPT9 | NM_006640.4(SEPT9): c.262C>T (p.Arg88Trp) | CCGAGCCGGTGTCCYGGCGCACT | Hereditary neuralgic amyotrophy |
| 80338762 | SEPT9 | NM_006640.4(SEPT9): c.278C>T (p.Ser93Phe) | CCCGGCGCACTGAGCTGTYCATT, CCGGCGCACTGAGCTGTYCATTG | Hereditary neuralgic amyotrophy |
| 28934586 | CYP11B1 | NM_000497.3(CYP11B1): c.1343G>A (p.Arg448His) | GCATGCRCCAGTGCCTTGGGCGG | Deficiency of steroid 11-beta-monooxygenase |
| 748979061 | GRM6 | NM_000843.3(GRM6): c.1462C>T (p.Gln488Ter) | TGCCTRGTACCCGCCACTGCTGG | Congenital stationary night blindness, type 1B |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 786205118 | CHKB | NM_005198.4(CHKB): c.677+1G>A | AACCTCAGRTGAGGGCAGGCAGG | Muscular dystrophy, congenital, megaconial type |
| 121965029 | IDUA | NM_000203.4(IDUA): c.266G>A (p.Arg89Gln) | GGTCCRGACCCACTGGCTGCTGG | Mucopolysaccharidosis, MPS-I-H/S, Hurler syndrome |
| 104893659 | PAX8 | NM_013953.3(PAX8): c.170G>A (p.Cys57Tyr) | GGCTRCGTCAGCAAGATCCTTGG | Thyroid agenesis |
| 104894062 | CYP11B1 | NM_000497.3(CYP11B1): c.1121G>A (p.Arg374Gln) | CTTGCRGTGGGTGCTGGCTGAGG | Deficiency of steroid 11-beta-monooxygenase |
| 104894231 | HRAS | NM_005343.2(HRAS): c.436G>A (p.Ala146Thr) | GACCTCGRCCAAGACCCGGCAGG | Costello syndrome |
| 104894335 | AQP2 | NM_000486.5(AQP2): c.523G>A (p.Gly175Arg) | CTTRGGGTAGGTCATGGCCATGG | |
| 104894341 | AQP2 | NM_000486.5(AQP2): c.568G>A (p.Ala190Thr) | CTGRCTCCAGCTGTCGTCACTGG | |
| 104894604 | NAGS | NM_153006.2(NAGS): c.971G>A (p.Trp324Ter) | AGTRGGTGAGCACAAAAGAACGG | Hyperammonemia, type III |
| 104894832 | GLA | NM_000169.2(GLA): c.982G>A (p.Gly328Arg) | GCAARGGTACCAGCTTAGACAGG | Fabry disease |
| 104894842 | GLA | NM_000169.2(GLA): c.1020G>A (p.Trp340Ter) | GTGTGRGAACGACCTCTCTCAGG | Fabry disease |
| 794726859 | SLC6A1 | NM_003042.3(SLC6A1): c.131G>A (p.Arg44Gln) | CCCGACCRGGACACGTGGAAGGG, CCCCGACCRGGACACGTGGAAGG | MYOCLONIC-ATONIC EPILEPSY |
| 794727219 | HADHA | NM_000182.4(HADHA): c.2146+1G>A | GGAGRTTGGTCTCGCAGGTTGGG, GGGAGRTTGGTCTCGCAGGTTGG | Mitochondrial trifunctional protein deficiency, Long-chain 3-hydroxyacyl-CoA dehydrogenase deficiency |
| 672601330 | ACY1 | NM_000666.2(ACY1): c.360-1G>A | TCARGTACCTGGAAGCTGTGAGG | Aminoacylase 1 deficiency |
| 794727995 | COPA | NM_001098398.1(COPA): c.721G>A (p.Glu241Lys) | TGGRAGGTTGATACCTGCCGGGG, ATGGRAGGTTGATACCTGCCGGG, CATGGRAGGTTGATACCTGCCGG | |
| 794728029 | ACTA2 | NM_001613.2(ACTA2): c.809G>A (p.Gly270Glu) | TTTCCAGRGATGGAGTCTGCTGG | Thoracic aortic aneurysms and aortic dissections |
| 397514667 | CD27 | NM_001242.4(CD27): c.158G>A (p.Cys53Tyr) | GGACTRTGACCAGCATAGAAAGG | Lymphoproliferative syndrome 2 |
| 397514668 | GDF5 | NM_000557.4(GDF5): c.1139G>A (p.Arg380Gln) | GCGAAAACRGCGGGCCCCACTGG | Brachydactyly type A2 |
| 794729274 | TTN | NM_001256850.1(TTN): c.49637G>A (p.Trp16546Ter) | AGTGAGCTRGACTCCTCCTTTGG | not provided |
| 377461670 | MYH7 | NM_000257.3(MYH7): c.5029C>T (p.Arg1677Cys) | GTTGTTGCRCCGCTCCACGATGG | Cardiomyopathy |
| 794729383 | TTN | NM_001256850.1(TTN): c.71708G>A (p.Trp23903Ter) | GTTAAATRGGGAAAGGTGGATGG | not provided |
| 121909129 | KRT86 | NM_002284.3(KRT86): c.1237G>A (p.Glu413Lys) | GGAGGGCRAGGAGCAGAGGTGGG, TGGAGGGCRAGGAGCAGAGGTGG | Beaded hair, not provided |
| 397516208 | MYH7 | NM_000257.3(MYH7): c.4276G>A (p.Glu1426Lys) | TGAGATCRAGGACTTGATGGTGG | Cardiomyopathy, not specified |
| 397516211 | MYH7 | NM_000257.3(MYH7): c.4348G>A (p.Asp1450Asn) | ACTTCRACAAGGTGGGCCCTGGG, AACTTCRACAAGGTGGGCCCTGG | Cardiomyopathy, not specified |
| 386834035 | POMGNT1 | NM_017739.3(POMGNT1): c.652+1G>A | AAAGGAGRTGCCGGCATCAGAGG | Muscle eye brain disease, Congenital muscular dystrophy-dystroglycanopathy with mental retardation, type B3 |
| 752034900 | ACO2 | NM_001098.2(ACO2): c.1981G>A (p.Gly661Arg) | GTGATCRGAGACGAGAACTACGG | Optic atrophy 9 |
| 57419521 | KRT81 | NM_002281.3(KRT81): c.1237G>A (p.Glu413Lys) | GGAGGGCRAGGAGCAGAGGTGGG, TGGAGGGCRAGGAGCAGAGGTGG | Beaded hair, not provided |
| 774122562 | RDH5 | NM_002905.3(RDH5): c.285G>A (p.Trp95Ter) | GTGRGTGGAGATGCACGTTAAGG | Pigmentary retinal dystrophy |
| 121908508 | SCO2 | NM_001169109.1(SCO2): c.107G>A (p.Trp36Ter) | TCCTRGCTTTTGTCAAGGCAGGG, GTCCTRGCTTTTGTCAAGGCAGG | Cardioencephalomyopathy, fatal infantile, due to cytochrome c oxidase deficiency |
| 199473684 | GLA | NM_000169.2(GLA): c.639+919G>A | CTARAGTGTAAGTTTCATGAGGG, ACTARAGTGTAAGTTTCATGAGG | Fabry disease, Fabry disease, cardiac variant |
| 121912591 | NAGS | NM_153006.2(NAGS): c.835G>A (p.Ala279Thr) | GGTGACCRGTCGCTGGCCAAGGG | Hyperammonemia, type III |
| 121912826 | COL4A3 | NM_000091.4(COL4A3): c.3044G>A (p.Gly1015Glu) | CCAGRAAGCATGGGGAACATGGG, ACCAGRAAGCATGGGGAACATGG | Benign familial hematuria |
| 730880914 | MYH7 | NM_000257.3(MYH7): c.5030G>A (p.Arg1677His) | GCGGCRCAACAACCTGCTGCAGG | Cardiomyopathy |
| 121912932 | COL5A1 | NM_000093.4(COL5A1): c.4466G>A (p.Gly1489Glu) | ATCRGCTCATCGGTCCTCCGGG, GATCRGCTCATCGGTCCTCCGG | Ehlers-Danlos syndrome, classic type |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199474822 | | m.7444G>A | AAAATCTARACAAAAAGGAAGG | Leber optic atrophy, Aminoglycoside-induced deafness, Deafness, nonsyndromic sensorineural, mitochondrial |
| 398123050 | RTEL1 | NM_016434.3(RTEL1): c.2141+5G>A | GGTGCRTGCAGTCCGGTGGCAGG | Dyskeratosis congenita, autosomal recessive, 5 |
| 115556836 | PTCH1 | NM_000264.3(PTCH1): c.2183C>T (p.Thr728Met) | ACTTCRTACAGGGGGGCTCGAGG | Holoprosencephaly 7, not specified, not provided |
| 201540674 | RTEL1 | RTEL1:c.2402G>A (p.Arg801His) | TCCAGCRCTGCCAAGCCTGCTGG | Idiopathic fibrosing alveolitis, chronic form, Dyskeratosiscongenita, autosomal recessive, 5, PULMONARY FIBROSISAND/OR BONE MARROW FAILURE, TELOMERE-RELATED, 3 |
| 62638208 | GRM6 | NM_000843.3(GRM6): c.1565G>A (p.Cys522Tyr) | TGCCCTRCGGGCCGGGGAGCGG | Congenital stationary night blindness, type 1B, not provided |
| 62638625 | GRM6 | NM_000843.3(GRM6): c.2341G>A (p.Glu781Lys) | TTCAACRAGGCCAAGCCCATCGG | Congenital stationary night blindness, type 1B, not provided |
| 796053008 | SCN1A | NM_001165963.1(SCN1A): c.4285G>A (p.Ala1429Thr) | AATAGRCCACATTCAAAGGATGG | not provided |
| 121917756 | HRAS | NM_005343.2(HRAS): c.187G>A (p.Glu63Lys) | GGAGRAGTACAGCGCCATGCGGG, AGGAGRAGTACAGCGCCATGCGG | Myopathy, congenital, with excess of muscle spindles |
| 121917775 | VIM | NM_003380.3(VIM): c.451G>A (p.Glu151Lys) | CCTCTACRAGGAGGAGATGCGGG, ACCTCTACRAGGAGGAGATGCGG | Cataract, nuclear diffuse nonprogressive, not provided |
| 121917995 | SCN1A | NM_006920.4(SCN1A): c.4874G>A (p.Arg1625Gln) | TCCRAGTGATCCGTCTTGCTAGG | Generalized epilepsy with febrile seizures plus, type 2, Epileptic encephalopathy Lennox-Gastaut type, not provided |
| 121918805 | SCN1A | NM_006920.4(SCN1A): c.4063G>A (p.Val1355Ile) | ATGGGCRTAAATTTGTTTGCTGG | Generalized epilepsy with febrile seizures plus, type 1, not provided |
| 768431507 | TTN | NM_001256850.1(TTN): c.49243C>T (p.Arg16415Ter) | CATTTCRGAACACTGAGCCAAGG | not provided |
| 368138001 | NPHP3 | NM_153240.4(NPHP3): c.3373C>T (p.Arg1125Ter) | AACTCRCTCCCTCATTTCTAAGG | Adolescent nephronophthisis, Renal-hepatic-pancreatic dysplasia, not provided |
| 730880440 | GLA | NM_000169.2(GLA): c.1019G>A (p.Trp340Ter) | GTGTRGGAACGACCTCTCTCAGG | not provided |
| 730880450 | GLA | NM_000169.2(GLA): c.713G>A (p.Ser238Asn) | GAAAARTATAAAGAGTATCTTGG | not provided |
| 267606745 | COL4A3 | NM_000091.4(COL4A3): c.3499G>A (p.Gly1167Arg) | GCCRGAGAAAAGGGAGAAACGGG, AGCCRGAGAAAAGGGAGAAACGG | Alport syndrome, autosomal dominant |
| 267606961 | POMGNT1 | NM_001243766.1(POMGNT1): c.1425G>A (p.Trp475Ter) | GGGATTRGGACATGTGGATGCGG | |
| 267607132 | TOP1 | NM_003286.2(TOP1): c.1748G+32 (p.Gly583=) | CATGGAGGRCTTGACAGCCAAGG | |
| 398122933 | CD27 | NM_001242.4(CD27): c.24G>A (p.Trp8Ter) | CCTGGTGRCTGTGCGTTCTGGGG, CCCTGGTGRCTGTGCGTTCTGGG | Lymphoproliferative syndrome 2 |
| 398122944 | CRYGC | NM_020989.3(CRYGC): c.471G>A (p.Trp157Ter) | CTGRGGGGCCATGGATGCTAAGG | Cataract, coppock-like |
| 398123019 | RTEL1 | NM_032957.4(RTEL1): c.823G>A (p.Glu275Lys) | CTTTGACRAAGCTCACAACGTGG | Dyskeratosis congenita, autosomal recessive, 5 |
| 281865424 | TYRP1 | NM_000550.2(TYRP1): c.1067G>A (p.Arg356Gln) | AGTTTCCRAAACACAGTGGAAGG | Oculocutaneous albinism type 3 |
| 111033564 | PRSS1 | NM_002769.4(PRSS1): c.235G>A (p.Glu79Lys) | ACAACATCRAGTCCTGGAGGGG | Hereditary pancreatitis |
| 121434424 | GDF1 | NM_001492.5(GDF1): c.485G>A (p.Gly162Asp) | GGGCGRCTGGGAGCTGAGCGTGG | Tetralogy of Fallot, not provided |
| 74315389 | GDF5 | NM_000557.4(GDF5): c.1471G>A (p.Glu491Lys) | GCAGTATRAGGACATGGTCGTGG | Symphalangism, proximal, 1b |
| 74315511 | SCO2 | NM_005138.2(SCO2): c.418G>A (p.Glu140Lys) | CCCAGACRAGCTGGAGAAGCTGG | Myopia 6, Cardioencephalomyopathy, fatal infantile, due tocytochrome c oxidase deficiency, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853207 | DDC | NM_001082971.1(DDC): c.304G>A (p.Gly102Ser) | CATCRGCTTCTCCTGGGTGAGGG, GCATCRGCTTCTCCTGGGTGAGG | Deficiency of aromatic-L-amino-acid decarboxylase |
| 786201031 | SPECC1L | NM_015330.4(SPECC1L): c.3247G>A (p.Gly1083Ser) | TGTCRGCATCAAATCCACACTGG | Opitz G/BBB syndrome |
| 387906858 | KCNJ13 | NM_002242.4(KCNJ13): c.496C>T (p.Arg166Ter) | AAAAGCTCRATTTTTTGGCCGGG | Leber congenital amaurosis 16 |
| 387907183 | ALG11 | NM_001004127.2(ALG11): c.1192G>A (p.Glu398Lys) | TGGAACRAGCATTTTGGGATTGG | Congenital disorder of glycosylation type 1P |
| 72646831 | TTN | NM_001267550.2(TTN): c.57331C>T (p.Arg19111Ter) | CCATGCTGGAGGGGTGATCYGAA | Primary dilated cardiomyopathy, Dilated cardiomyopathy 1G, not provided |
| 750586158 | RAD50 | NM_005732.3(RAD50): c.3598C>T (p.Arg1200Ter) | CCTTGGATATGCGAGGAYGATGC | Hereditary cancer-predisposing syndrome |
| 34516117 | KCNQ1 | NM_000218.2(KCNQ1): c.1799C>T (p.Thr600Met) | CCTTTGTCCCCGCAGGTGAYGCA | Long QT syndrome, Congenital long QT syndrome, Cardiac arrhythmia |
| 786205700 | RTEL1 | NM_032957.4(RTEL1): c.1523C>T (p.Pro508Leu) | CCAGCGGCACGCTGGCCCYGGTG | PULMONARY FIBROSIS AND/OR BONE MARROW FAILURE, TELOMERE-RELATED, 3 |
| 786205701 | RTEL1 | NM_032957.4(RTEL1): c.2149C>T (p.Gln717Ter) | CCAGGGCTGTGAACYAGGCCATC | PULMONARY FIBROSIS AND/OR BONE MARROW FAILURE, TELOMERE-RELATED, 3 |
| 104893940 | ARG1 | NM_000045.3(ARG1): c.871C>T (p.Arg291Ter) | CCAGAAGAAGTAACTYGAACAGT | Arginase deficiency |
| 104894069 | CYP11B1 | NM_000497.3(CYP11B1): c.124C>T (p.Pro42Ser) | CCCTTTGAAGCCATGYCCCGGCG, CCTTTGAAGCCATGYCCCGGCGT | Congenital adrenal hyperplasia, Deficiency of steroid 11-beta-monooxygenase |
| 145100473 | SCO2 | NM_001169109.1(SCO2): c.341G>A (p.Arg114His) | CCGGAAGTCAGCCTTGCAGYGAG | Myopia 6 |
| 104894333 | AQP2 | NM_000486.5(AQP2): c.374C>T (p.Thr125Met) | CCCCAGCTCAGCAACAGCAYGAC, CCCAGCTCAGCAACAGCAYGACG, CCAGCTCAGCAACAGCAYGACGG | |
| 794726710 | SCN1A | NM_001165963.1(SCN1A): c.3637C>T (p.Arg1213Ter) | CCTGAGAAGGACGTGTTTCYGAA | Severe myoclonic epilepsy in infancy, not provided |
| 794726752 | SCN1A | NM_001165963.1(SCN1A): c.4573C>T (p.Arg1525Ter) | CCGCAAAAGCCTATACCTYGACC | Severe myoclonic epilepsy in infancy, not provided |
| 794726759 | SCN1A | NM_001165963.1(SCN1A): c.4933C>T (p.Arg1645Ter) | CCGTCTTGCTAGGATTGGCYGAA | Severe myoclonic epilepsy in infancy |
| 104894837 | GLA | NM_000169.2(GLA): c.436C>T (p.Pro146Ser) | CCTGCGCAGGCTTCYCTGGGAGT | Fabry disease |
| 200970763 | PIEZO1 | NM_001142864.3(PIEZO1): c.2344G>A (p.Gly782Ser) | CCGCTCAGCCACCAGGCYCCACT | Xerocytosis |
| 794726988 | RAD51D | NM_002878.3(RAD51D): c.955C>T (p.Gln319Ter) | CCTGGGGGACCTCAGAGYAGAGT | Breast-ovarian cancer, familial 4 |
| 794728015 | SOX18 | NM_018419.2(SOX18): c.481C>T (p.Gln161Ter) | CCGGCCGCGCCGCAAGAAGYAGG, CCGCGCCGCAAGAAGYAGGCGCG | Hypotrichosis-lymphedema-telangiectasia syndrome |
| 794728540 | KCNQ1 | NM_000218.2(KCNQ1): c.1801C>T (p.Gln601Ter) | CCCCGCAGGTGACGYAGCTGGAC | Cardiac arrhythmia |
| 28940869 | POMGNT1 | NM_017739.3(POMGNT1): c.1324C>T (p.Arg442Cys) | CCCAGCACTACTGTACYGTGTGG, CCAGCACTACTGTACYGTGTGGA | Congenital muscular dystrophy |
| 794729279 | TTN | NM_001256850.1(TTN): c.58702C>T (p.Arg19568Ter) | CCCCTAAAGTCACTTGGYGAAAA, CCCTAAAGTCACTTGGYGAAAAG, CCTAAAGTCACTTGGYGAAAAGT | not provided |
| 794729305 | TTN | NM_001256850.1(TTN): c.96304C>T (p.Arg32102Ter) | CCGTGTAGGACAGGCCYGAGAAA | not provided |
| 794729384 | TTN | NM_001256850.1(TTN): c.81193C>T (p.Arg27065Ter) | CCATTCAGAGCTTAYGAGGGACA | not provided |
| 397517326 | CDH23 | NM_022124.5(CDH23): c.3628C>T (p.Gln1210Ter) | CCCCCGTGTTCACAYAGCAGCAG | Usher syndrome, type 1D |
| 147708782 | MYH2 | NM_017534.5(MYH2): c.706G>A (p.Ala236Thr) | CCTCACGGTCTTGGYGTTGCCAA | Inclusion body myopathy 3 |
| 121908189 | MFRP | NM_031433.3(MFRP): c.523C>T (p.Gln175Ter) | CCACTGCGTGTGGCATATCYAGG | Nanophthalmos 2 |
| 121908350 | CDH23 | NM_022124.5(CDH23): c.3880C>T (p.Gln1294Ter) | CCAGGCCCCGCCCTTCAACYAGG, CCCCGCCCTTCAACYAGGGCTTC | Usher syndrome, type 1D |
| 121908490 | SGCE | NM_003919.2(SGCE): c.304C>T (p.Arg102Ter) | CCGACCTGGATGGCTTYGATATA | Myoclonic dystonia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909106 | FOXC2 | NM_005251.2(FOXC2): c.374C>T (p.Ser125Leu) | CCGCCACAACCTCTYGCTCAACG | Distichiasis-lymphedema syndrome |
| 121909117 | SOX10 | NM_006941.3(SOX10): c.470C>T (p.Ala157Val) | CCCCTTCATCGAGGAGGYTGAGC, CCCTTCATCGAGGAGGYTGAGCG, CCTTCATCGAGGAGGYTGAGCGG | Waardenburg syndrome type 4C |
| 121909501 | TDGF1 | NM_001174136.1(TDGF1): c.326C>T (p.Pro109Leu) | CCCCATGACACCTGGCTGCYCAA, CCCATGACACCTGGCTGCYCAAG, CCATGACACCTGGCTGCYCAAGA | Forebrain defects |
| 121909511 | CHRNE | NM_000080.3(CHRNE): c.865C>T (p.Leu289Phe) | CCAGACCGTCTTCTTGTTCYTCA, CCGTCTTCTTGTTCYTCATTGCC | Myasthenia, familial infantile, 1 |
| 121909512 | CHRNE | NM_000080.3(CHRNE): c.422C>T (p.Pro141Leu) | CCGTGACGTGGCTGCCTCYGGCC | MYASTHENIC SYNDROME, CONGENITAL, 4B, FAST-CHANNEL |
| 121909595 | CRYGD | NM_006891.3(CRYGD): c.43C>T (p.Arg15Cys) | CCGGGGCTTCCAGGGCYGCCACT | Cataract 4 |
| 121912420 | SERPIND1 | NM_000185.3(SERPIND1): c.1385C>T (p.Pro462Leu) | CCACGGTGGGGTTCATGCYGCTG | Heparin cofactor II deficiency |
| 111033571 | TRIM32 | NM_012210.3(TRIM32): c.388C>T (p.Pro130Ser) | CCGGGAGGCAGACCATCAGYCTC | Bardet-Biedl syndrome, Bardet-Biedl syndrome 11 |
| 121912700 | ACY1 | NM_000666.2(ACY1): c.589C>T (p.Arg197Trp) | CCTCCCCAGGGGTGYGGGTTACC | Aminoacylase 1 deficiency |
| 121912978 | CYP11B2 | NM_000498.3(CYP11B2): c.554C>T (p.Thr185Ile) | CCCGGGGGAGCCTGAYCCTGGAC, CCGGGGGAGCCTGAYCCTGGACG | Corticosterone methyloxidase type 2 deficiency |
| 730882050 | ALG14 | NM_144988.3(ALG14): c.194C>T (p.Pro65Leu) | CCAATGCCTACTCACYTAGACAT | Myasthenic syndrome, congenital, without tubular aggregates |
| 761807131 | TTN | NM_001256850.1(TTN): c.46513+1G>A | CCATGTCCAAACTTAYGCTTTGG | not provided |
| 730882144 | MFRP | NM_031433.3(MFRP): c.1549C>T (p.Arg517Trp) | CCCTGCTACCAGCATTTCYGGAG, CCTGCTACCAGCATTTCYGGAGG | Microphthalmia, isolated 5 |
| 61752068 | RS1 | NM_000330.3(RS1): c.305G>A (p.Arg102Gln) | CCTTGACTGTTGAGCYGGGCCTT | Juvenile retinoschisis, not provided |
| 119456962 | NPHP3 | NM_153240.4(NPHP3): c.1729C>T (p.Arg577Ter) | CCTCCTTGATTATTAAAYGACTA, CCTTGATTATTAAAYGACTAACT | Adolescent nephronophthisis, Renal-hepatic-pancreaticdysplasia, Meckel syndrome type 7, not provided |
| 74315310 | FCGR1A | NM_000566.3(FCGR1A): c.274C>T (p.Arg92Ter) | CCAGAGAGGTCTCTCAGGGYGAA | |
| 41469351 | CCR5 | NM_000579.3(CCR5): c.-229C>T | CCCGTAAATAAACCTTYAGACCA, CCGTAAATAAACCTTYAGACCAG | |
| 62638185 | RDH5 | NM_002905.3(RDH5): c.218C>T (p.Ser73Phe) | CCTGCAGCGGGTGGCCTYCTCCC | |
| 796053004 | SCN1A | NM_001165963.1(SCN1A): c.3985C>T (p.Arg1329Ter) | CCTCTAAGAGCCTTATCTYGATT | Severe myoclonic epilepsy in infancy, not provided |
| 796053103 | SCN1A | NM_001165963.1(SCN1A): c.5710C>T (p.Gln1904Ter) | CCTTCCAAGGTCTCCTATYAGCC, CCAAGGTCTCCTATYAGCCAATC | not provided |
| 121917886 | P2RY12 | NM_022788.4(P2RY12): c.793C>T (p.Arg265Trp) | CCCTGAGCCAAACCYGGGATGTC | Platelet-type bleeding disorder 8 |
| 121917903 | ERCC6 | NM_000124.3(ERCC6): c.229C>T (p.Arg77Ter) | CCCTGCTGCACATCGACYGACAT, CCTGCTGCACATCGACYGACATC | UV-sensitive syndrome |
| 121918450 | ITGB3 | NM_000212.2(ITGB3): c.2248C>T (p.Arg750Ter) | CCTCATCACCATCCACGACYGAA | Glanzmann thrombasthenia |
| 727503949 | GLA | NM_000169.2(GLA): c.658C>T (p.Arg220Ter) | CCCAATTATACAGAAATCYGACA, CCAATTATACAGAAATCYGACAG | Fabry disease |
| 202102042 | NPPA | NM_006172.3(NPPA): c.449G>A (p.Arg150Gln) | CCCCAGTTCCTCTTACCYGGAAG, CCCAGTTCCTCTTACCYGGAAGC, CCAGTTCCTCTTACCYGGAAGCT | Atrial standstill 2 |
| 202003805 | PRSS1 | NM_002769.4(PRSS1): c.47C>T (p.Ala16Val) | CCACTCCAGTTGCTGYCCCCTTT | Hereditary pancreatitis |
| 587781698 | ATM | NM_000051.3(ATM): c.8998C>T (p.Gln3000Ter) | CCTTAGTGATATTGACYAGAGTT | Hereditary cancer-predisposing syndrome |
| 148231754 | TTN | NM_001256850.1(TTN): c.83086+5G>A | CCCTTCCCATGACAAATAYGTAC, CCTTCCCATGACAAATAYGTACC | not provided |
| 587781756 | RAD51D | NM_002878.3(RAD51D): c.451C>T (p.Gln151Ter) | CCGCCTCCTCCAGCTGCTTYAGG, CCTCCTCCAGCTGCTTYAGGCTA | Hereditary cancer-predisposing syndrome |
| 137853289 | ABCA12 | NM_173076.2(ABCA12): c.6610C>T (p.Arg2204Ter) | CCATGTTTTTTCCTTGYGACTC | Autosomal recessive congenital ichthyosis 4B |
| 116840809 | RPL35A | NM_000996.2(RPL35A): c.304C>T (p.Arg102Ter) | CCATTGGACACAGAATCYGAGTG | Diamond-Blackfan anemia 5 |
| 587782695 | RAD51D | NM_002878.3(RAD51D): c.547C>T (p.Gln183Ter) | CCAGATGCTGGATGTGCTGYAGG | Hereditary cancer-predisposing syndrome |
| 119462978 | KIRREL3 | NM_032531.3(KIRREL3): c.118C>T (p.Arg40Trp) | CCAAGGACAAGTTTYGGAGAATG | Mental retardation, autosomal dominant 4 |
| 398123812 | SGCE | NM_003919.2(SGCE): c.709C>T (p.Arg237Ter) | CCCGTTTTCTTCTTGTTTAYGAG, CCGTTTTCTTCTTGTTTAYGAGA | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397518485 | TRAF3IP2 | NM_147686.3(TRAF3IP2): c.1580C>T (p.Thr527Ile) | CCCACCTGGCTTCAGAACAYTCA, CCACCTGGCTTCAGAACAYTCAT, CCTGGCTTCAGAACAYTCATGTC | Candidiasis, familial, 8 |
| 794726839 | SCN1A | NM_001165963.1(SCN1A): c.4985C>T (p.Ala1662Val) | CCGCACGCTGCTCTTTGYTTTGA | Severe myoclonic epilepsy in infancy |
| 60035576 | KRT10 | NM_000421.3(KRT10): c.1300C>T (p.Gln434Ter) | CCAGAATACTGAATACCAAYAAC | Bullous ichthyosiform erythroderma, not provided |
| 779874042 | TTN | NM_001256850.1(TTN): c.77716G>T (p.Glu25906Ter) | CCCACACCAGCTGCATTTHAGC, CCACACCAGCTGCATTTTHAGCA | not provided |
| 121434219 | ATM | NM_000051.3(ATM): c.9139C>T (p.Arg3047Ter) | CCCCAAAAATCTCAGCYGACTTT, CCCAAAAATCTCAGCYGACTTTT, CCAAAAATCTCAGCYGACTTTTC | Ataxia-telangiectasia syndrome |
| 121434306 | LPAR6 | NM_005767.5(LPAR6): c.463C>T (p.Gln155Ter) | CCCGCCGTTTTTGTTYAGTCTAC, CCGCCGTTTTTGTTYAGTCTACC | Hypotrichosis 8 |
| 121434405 | RPL5 | NM_000969.3(RPL5): c.67C>T (p.Arg23Ter) | CCAAGTGAAATTTAGAAGAYGAC | Aase syndrome |
| 121434410 | PRKRA | NM_003690.4(PRKRA): c.665C>T (p.Pro222Leu) | CCTTGAGGAATTCTCYTGGTGAA | Dystonia 16 |
| 121434534 | CYP19A1 | NM_031226.2(CYP19A1): c.1303C>T (p.Arg435Cys) | CCATTTGGCTTTGGGCCCYGTGG | Aromatase deficiency |
| 121434571 | ERCC5 | NM_000123.3(ERCC5): c.2375C>T (p.Ala792Val) | CCCATGGAAGCAGAGGYGCAGTG, CCATGGAAGCAGAGGYGCAGTGC | Xeroderma pigmentosum, group G |
| 137852293 | PHKA2 | NM_000292.2(PHKA2): c.3341C>T (p.Thr1114Ile) | CCCTTTGGTAGATGAYCCCGCAT, CCTTTGGTAGATGAYCCCGCATG | Glycogen storage disease IXa2 |
| 74315359 | PINK1 | NM_032409.2(PINK1): c.938C>T (p.Thr313Met) | CCTGGGCCATGGCCGGAYGCTGT | Parkinson disease 6, autosomal recessive early-onset |
| 372635387 | CHRNE | NM_000080.3(CHRNE): c.37G>A (p.Gly13Arg) | CCGTACCGAGAAGCCYCAAGAGG | MYASTHENIC SYNDROME, CONGENITAL, 4B, FAST-CHANNEL |
| 74315520 | SOX10 | NM_006941.3(SOX10): c.1129C>T (p.Gln377Ter) | CCAGCCATCCACCTCAYAGATCG | Waardenburg syndrome type 4C, Waardenburg syndrome type 2E, with neurologic involvement |
| 74315521 | SOX10 | NM_006941.3(SOX10): c.748C>T (p.Gln250Ter) | CCCCGAAGACAGAGCTGYAGTCG, CCCGAAGACAGAGCTGYAGTCGG, CCGAAGACAGAGCTGYAGTCGGG | Peripheral demyelinating neuropathy, central dysmyelination, Waardenburg syndrome, and Hirschsprung disease |
| 137852824 | PCSK1 | NM_000439.4(PCSK1): c.920C>T (p.Ser307Leu) | CCATCTTCGTCTGGGCTTYGGGA | Proprotein convertase 1/3 deficiency |
| 137852973 | BSCL2 | NM_001122955.3(BSCL2): c.461C>T (p.Ser154Leu) | CCCTGTTGCCAATGTCTYGCTGA, CCTGTTGCCAATGTCTYGCTGAC | Silver spastic paraplegia syndrome |
| 137852974 | BSCL2 | NM_001122955.3(BSCL2): c.1015C>T (p.Arg339Ter) | CCTCCACAGGTTAACATCYGAAA, CCACAGGTTAACATCYGAAAAAG | Congenital generalized lipodystrophy type 2 |
| 137853211 | DDC | NM_001082971.1(DDC): c.272C>T (p.Ala91Val) | CCCGGCCATGCTTGYGGACATGC | Deficiency of aromatic-L-amino-acid decarboxylase |
| 387906570 | APOA1 | NM_000039.1(APOA1): c.67C>T (p.Gln23Ter) | CCAGGCTCGGCATTTCTGGYAGC | Tangier disease |
| 387906669 | ACP5 | NM_001111035.1(ACP5): c.667C>T (p.Gln223Ter) | CCCACTGCCTGGTCAAGYAGCTA, CCACTGCCTGGTCAAGYAGCTAC | Spondyloenchondrodysplasia with immune dysregulation |
| 80051519 | CYP19A1 | NM_031226.2(CYP19A1): c.1094G>A (p.Arg365Gln) | CCACGACAGGCTGGTACYGCATG | Aromatase deficiency |
| 387907268 | PRCD | NM_001077620.2(PRCD): c.64C>T (p.Arg22Ter) | CCGCCGATTTGCCAACYGAGTCC | Retinitis pigmentosa 36 |
| 387907279 | FAN1 | NM_014967.4(FAN1): c.2245C>T (p.Arg749Ter) | CCGCCTTTCACTGTATCAGYGAG, CCTTTCACTGTATCAGYGAGCCG | Interstitial nephritis, karyomegalic |
| 543267101 | AARS2 | NM_020745.3(AARS2): c.2893G>A (p.Gly965Arg) | CCAGGTCAGTAGTGCTTCYGGTG | Leukoencephalopathy, progressive, with ovarian failure |
| 587777592 | AARS2 | NM_020745.3(AARS2): c.1213G>A (p.Glu405Lys) | CCAGGAAGGCTGCCTYGTCCTCT | Leukoencephalopathy, progressive, with ovarian failure |
| 587777125 | AASS | NM_005763.3(AASS): c.194G>A (p.Arg65Gln) | CCTTATCATGAATGGCCYGCCGA | Hyperlysinemia |
| 121434578 | ABAT | NM_000663.4(ABAT): c.659G>A (p.Arg220Lys) | GGGARGACCATGGGTAAGGAGGG, TGGGARGACCATGGGTAAGGAGG, CCATGGGARGACCATGGGTAAGG | Gamma-aminobutyric acid transaminase deficiency |
| 724159990 | ABAT | NM_000663.4(ABAT): c.631C>T (p.Leu211Phe) | CCCGACTACAGCATCYTCTCCT, CCCGACTACAGCATCYTCTCCTT, CCGACTACAGCATCYTCTCCTTC | Gamma-aminobutyric acid transaminase deficiency |
| 137854495 | ABCA1 | NM_005502.3(ABCA1): c.2810C>T (p.Ala937Val) | CCTGGGCCACAATGGAGYGGGGA | Tangier disease |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28940270 | ABCA12 | NM_173076.2(ABCA12): c.4541G>A (p.Arg1514His) | ATGTTCTCRCCGAAGTATATGGG | Autosomal recessive congenital ichthyosis 4A |
| 121909181 | ABCA3 | NM_001089.2(ABCA3): c.3426G>A (p.Trp1142Ter) | CTGRCTCTCTGCTCTGCTGTGGG, TCTGRCTCTCTGCTCTGCTGTGG | Surfactant metabolism dysfunction, pulmonary, 3 |
| 61750061 | ABCA4 | NM_000350.2(ABCA4): c.3106G>A (p.Glu1036Lys) | GTCCCAGRAGGAGGCCCAGCTGG | Stargardt disease 1, not provided |
| 61751399 | ABCA4 | NM_000350.2(ABCA4): c.3364G>A (p.Glu1122Lys) | GGACRAGGCCGACCTCCTTGGGG, TGGACRAGGCCGACCTCCTTGGG, ATGGACRAGGCCGACCTCCTTGG | Stargardt disease 1, not provided |
| 1800553 | ABCA4 | NM_000350.2(ABCA4): c.5882G>A (p.Gly1961Glu) | TGTCGRAGTTCGCCCTGGAGAGG | Stargardt disease 1, Cone-rod dystrophy 3, not provided |
| 794727531 | ABCA4 | NM_000350.2(ABCA4): c.4429C>T (p.Gln1477Ter) | CCCAGCTGTTCCAGAAGYAGAAA, CCAGCTGTTCCAGAAGYAGAAAT | Stargardt disease 1 |
| 794727903 | ABCA4 | NM_000350.2(ABCA4): c.880C>T (p.Gln294Ter) | CCATCGGCCGAGTATGYAGGACT | Stargardt disease 1, Cone-rod dystrophy 3 |
| 61748550 | ABCA4 | NM_000350.2(ABCA4): c.1222C>T (p.Arg408Ter) | CCTGATTCACCTGCAGCAYGAAG | Retinitis pigmentosa 19, Stargardt disease 1, Cone-rod dystrophy 3, Age-related macular degeneration 2, not provided |
| 61750130 | ABCA4 | NM_000350.2(ABCA4): c.4139C>T (p.Pro1380Leu) | CCCACAGATCGTGCTCCYGGCTA, CCACAGATCGTGCTCCYGGCTAC | Stargardt disease 1, not provided |
| 28938473 | ABCA4 | NM_000350.2(ABCA4): c.5908C>T (p.Leu1970Phe) | CCTAGTGCTTTGGCYTCCTGGGA | Stargardt disease, not provided |
| 72549401 | ABCB11 | NM_003742.2(ABCB11): c.1723C>T (p.Arg575Ter) | GGGATTTCRGATGAGGGCTCTGG | Progressive familial intrahepatic cholestasis 2 |
| 72552778 | ABCB4 | NM_018849.2(ABCB4): c.959C>T (p.Ser320Phe) | CCTTCTGGTATGGATYCACTCTA | Cholecystitis, Progressive familial intrahepatic cholestasis 3, Cholestasis, intrahepatic, of pregnancy 3 |
| 121918440 | ABCB4 | NM_018849.2(ABCB4): c.2869C>T (p.Arg957Ter) | CCTATGCCGGTTGTTTTYGATTT | Progressive familial intrahepatic cholestasis 3, Cholestasis, intrahepatic, of pregnancy 3 |
| 121918442 | ABCB4 | NM_018849.2(ABCB4): c.3502C>T (p.Pro1168Ser) | CCTTTCATCGAGACGTTAYCCCA | Cholecystitis |
| 72558200 | ABCC2 | NM_000392.4(ABCC2): c.3449G>A (p.Arg1150His) | GGCRTCTGGACTCTGTCACCAGG | Dubin-Johnson syndrome |
| 63749823 | ABCC6 | NM_001171.5(ABCC6): c.3961G>A (p.Gly1321Ser) | GAGRGTGGGATCTGGATCGACGG | Pseudoxanthoma elasticum |
| 28939701 | ABCC6 | NM_001171.5(ABCC6): c.3412C>T (p.Arg1138Trp) | CCAGGGCAGCACAGTGGTCYGGG | Pseudoxanthoma elasticum |
| 72653744 | ABCC6 | NM_001171.5(ABCC6): c.3490C>T (p.Arg1164Ter) | CCAGAGGATCAGTTTCCCGYGAC | Pseudoxanthoma elasticum |
| 63750459 | ABCC6 | NM_001171.5(ABCC6): c.3389C>T (p.Thr1130Met) | CCCACATGGCTGAGAYGTTCCAG, CCACATGGCTGAGAYGTTCCAGG | Pseudoxanthoma elasticum |
| 63750759 | ABCC6 | NM_001171.5(ABCC6): c.3940C>T (p.Arg1314Trp) | CCTGGCCAGTGGGCTGCTGYGGC, CCAGTGGGCTGCTGYGGCTCCAG | Pseudoxanthoma elasticum, Generalized arterial calcification of infancy 2 |
| 193922402 | ABCC8 | NM_000352.4(ABCC8): c.4306C>T (p.Arg1436Ter) | CCTCTTCAGCGGCACCATCYGGT | Persistent hyperinsulinemic hypoglycemia of infancy, familial hyperinsulinism |
| 387906805 | ABCC9 | NM_005691.3(ABCC9): c.4640C>T (p.Thr1547Ile) | CCACTTTGGTGATGAYCAACAAG | Atrial fibrillation, familial, 12 |
| 387907228 | ABCC9 | NM_005691.3(ABCC9): c.3346C>T (p.Arg1116Cys) | CCTTGGAATCTCTAACTYGCTCA | Hypertrichotic osteochondrodysplasia |
| 11146842 | ABCD1 | NM_000033.3(ABCD1): c.1850G>A (p.Arg617His) | TGGCCCRCATGTTCTACCACAGG | Adrenoleukodystrophy |
| 150346282 | ABCD1 | NM_000033.3(ABCD1): c.1825G>A (p.Glu609Lys) | GGTGGCRAGAAGCAGAGAATCGG | Adrenoleukodystrophy |
| 128624213 | ABCD1 | NM_000033.3(ABCD1): c.871G>A (p.Glu291Lys) | TCGRAGGAGATCGCCTTCTATGG | Adrenoleukodystrophy |
| 128624218 | ABCD1 | NM_000033.3(ABCD1): c.796G>A (p.Gly266Arg) | GTTCRGGGAGCTGGTGGCAGAGG | Adrenoleukodystrophy |
| 398123102 | ABCD1 | NM_000033.3(ABCD1): c.1553G>A (p.Arg518Gln) | TCCRGATCCTGGGTGGGCTCTGG | Adrenoleukodystrophy |
| 398123107 | ABCD1 | NM_000033.3(ABCD1): c.1802G>A (p.Trp601Ter) | GACTRGAAGGACGTCCTGTCGGG, TGACTRGAAGGACGTCCTGTCGG | Adrenoleukodystrophy |
| 398123105 | ABCD1 | NM_000033.3(ABCD1): c.1679C>T (p.Pro560Leu) | CCAGGTGATCTACCYGGACTCAG | Adrenoleukodystrophy |
| 398123106 | ABCD1 | NM_000033.3(ABCD1): c.1771C>T (p.Arg591Trp) | CCTGCACCACATCCTGCAGYGGG | Adrenoleukodystrophy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777603 | ABHD12 | NM_015600.4(ABHD12): c.477G>A (p.Trp159Ter) | CCAAGGCATCCTCATAYCACATC | Polyneuropathy, hearing loss, ataxia, retinitis pigmentosa, and cataract |
| 387906517 | ABL1 | NM_007313.2(ABL1): c.763G>A (p.Glu255Lys) | CAAGTGGRAGATGGAACGCACGG | |
| 121913459 | ABL1 | NM_007313.2(ABL1): c.1001C>T (p.Thr334Ile) | CCCCCGTTCTATATCATCAYTGA, CCCCGTTCTATATCATCAYTGAG, CCCGTTCTATATCATCAYTGAGT, CCGTTCTATATCATCAYTGAGTT | |
| 368949613 | ACAD9 | NM_014049.4(ACAD9): c.1249C>T (p.Arg417Cys) | CCGTACGAGCGCATACTGYGTGA | Acyl-CoA dehydrogenase family, member 9, deficiency of |
| 121434278 | ACADM | NM_000016.5(ACADM): c.583G>A (p.Gly195Arg) | CCAACRGAGGAAAAGCTAATTGG | Medium-chain acyl-coenzyme A dehydrogenase deficiency, not provided |
| 1799958 | ACADS | NM_000017.3(ACADS): c.625G>A (p.Gly209Ser) | TCAGRGCATCAGTGCCTTCCTGG | Deficiency of butyryl-CoA dehydrogenase, not specified, not provided |
| 387906951 | ACADS | NM_000017.3(ACADS): c.323G>A (p.Gly108Asp) | AGCCGTGRCTGCGCCTCCACCGG | Deficiency of butyryl-CoA dehydrogenase |
| 28940872 | ACADS | NM_000017.3(ACADS): c.1147C>T (p.Arg383Cys) | CCGGCAGAGCGGCACTACYGCGA | Deficiency of butyryl-CoA dehydrogenase, not provided |
| 28940874 | ACADS | NM_000017.3(ACADS): c.575C>T (p.Ala192Val) | CCAATGCCTGGGAGGYTTCGGCT | Deficiency of butyryl-CoA dehydrogenase |
| 28941773 | ACADS | NM_000017.3(ACADS): c.1058C>T (p.Ser353Leu) | CCAAGCTGGCCGCCTYGGAGGCC | Deficiency of butyryl-CoA dehydrogenase, not provided |
| 121908006 | ACADS | NM_000017.3(ACADS): c.973C>T (p.Arg325Trp) | CCTGGCCCTGGAGAGTGCCYGGC, CCCTGGAGAGTGCCYGGCTGCTG | Deficiency of butyryl-CoA dehydrogenase, not provided |
| 61732144 | ACADS | NM_000017.3(ACADS): c.319C>T (p.Arg107Cys) | CCATGGAGGAGATCAGCYGTGGC | Deficiency of butyryl-CoA dehydrogenase, not provided |
| 147442301 | ACADS | NM_000017.3(ACADS): c.164C>T (p.Pro55Leu) | CCGAGAAGGAGTTGTTTCYCATT | Deficiency of butyryl-CoA dehydrogenase |
| 188094280 | ACADSB | NM_001609.3(ACADSB): c.1159G>A (p.Glu387Lys) | ATCRAGTGGATGGGGGAGTAGG | Deficiency of 2-methylbutyryl-CoA dehydrogenase |
| 137852649 | ACADSB | NM_001609.3(ACADSB): c.763C>T (p.Leu255Phe) | CCTGAAAACAAATTGGGGYTCAG | Deficiency of 2-methylbutyryl-CoA dehydrogenase |
| 533055438 | ACADVL | NM_000018.3(ACADVL): c.1316G>A (p.Gly439Asp) | GGGGGRTATGGGCTTCATGAAGG | not provided |
| 2309689 | ACADVL | NM_000018.3(ACADVL): c.1322G>A (p.Gly441Asp) | TATGGRCTTCATGAAGGTACAGG | Very long chain acyl-CoA dehydrogenase deficiency, not provided |
| 766742117 | ACADVL | NM_000018.3(ACADVL): c.1375C>T (p.Arg459Trp) | CCGAGATCTTCGCATCTTCYGGA | not provided |
| 118204014 | ACADVL | NM_000018.3(ACADVL): c.1837C>T (p.Arg613Trp) | CCCCAGGCTGCAGCTYGGATCCG, CCCAGGCTGCAGCTYGGATCCGA | Very long chain acyl-CoA dehydrogenase deficiency, not provided |
| 121913568 | ACAN | NM_013227.3(ACAN): c.7141G>A (p.Asp2381Asn) | GAACRACAGGACCATCGAAGGGG, TGAACRACAGGACCATCGAAGGG, CTGAACRACAGGACCATCGAAGG | Spondyloepimetaphyseal dysplasia, Aggrecan type |
| 267606625 | ACAN | NM_013227.3(ACAN): c.7249G>A (p.Val2417Met) | AGGACTGTRTGGTGATGATCTGG | Osteochondritis dissecans |
| 121912703 | ACE | NM_000789.3(ACE): c.3683C>T (p.Pro1228Leu) | CCGCAGTACAACTGGACGCYGAA | Angiotensin i-converting enzyme, benign serum increase |
| 118204093 | ACOX1 | NM_004035.6(ACOX1): c.442C>T (p.Arg148Ter) | CCTTAGGAACTCACCTTYGAGGC | Pseudoneonatal adrenoleukodystrophy |
| 757905943 | ACSF3 | NM_174917.4(ACSF3): c.348G>A (p.Trp116Ter) | GTCATGRATGAGTGGCGGTGTGG | not provided |
| 138680796 | ACSF3 | NM_174917.4(ACSF3): c.1411C>T (p.Arg471Trp) | CCAGTACTGGATCCGAGGCYGGA | Combined malonic and methylmalonic aciduria |
| 140986055 | ACSF3 | NM_174917.4(ACSF3): c.728C>T (p.Pro243Leu) | CCTCCACGTGCTCCYGCTGCACC | Combined malonic and methylmalonic aciduria |
| 367543051 | ACTA1 | NM_001100.3(ACTA1): c.727G>A (p.Glu243Lys) | CTACRAGCTGCCAGACGGGCAGG, AGAGCTACRAGCTGCCAGACGGG | Congenital myopathy with fiber type disproportion |
| 267606627 | ACTA1 | NM_001100.3(ACTA1): c.223C>T (p.His75Tyr) | CCTGAAGTACCCTATCGAGYACG | Nemaline myopathy 3 |
| 794728021 | ACTA2 | NM_001613.2(ACTA2): c.116G>A (p.Arg39His) | GACRTCCCAGACATCAGGTGAGG, TGTGGGACRTCCCAGACATCAGG | Thoracic aortic aneurysms and aortic dissections |
| 387906592 | ACTA2 | NM_001613.2(ACTA2): c.536G>A (p.Arg179His) | ATCATGCRTCTGGATCTGGCTGG | Aortic aneurysm, familial thoracic 6, Thoracic aortic aneurysms and aortic dissections, Multisystemic smooth muscle dysfunction syndrome, Moyamoya disease 5 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 112901682 | ACTA2 | NM_001141945.1(ACTA2): c.115C>T (p.Arg39Cys) | CCCATCCATTGTGGGABGTCCCA, CCATCCATTGTGGGABGTCCCAG | Aortic aneurysm, familial thoracic 6, Thoracic aortic aneurysms and aortic dissections |
| 397515470 | ACTB | NM_001101.3(ACTB): c.349G>A (p.Glu117Lys) | CAACCGCRAGAAGATGACCCAGG | Baraitser-Winter syndrome 1 |
| 587779770 | ACTB | NM_001101.3(ACTB): c.220G>A (p.Gly74Ser) | GCACRGCATCGTCACCAACTGGG, AGCACRGCATCGTCACCAACTGG | Baraitser-Winter syndrome 1 |
| 587779769 | ACTB | NM_001101.3(ACTB): c.209C>T (p.Pro70Leu) | CCTCACCCTGAAGTACCYCATCG | Baraitser-Winter syndrome 1 |
| 587779774 | ACTB | NM_001101.3(ACTB): c.359C>T (p.Thr120Ile) | CCAACCGCGAGAAGATGAYCCAG, CCGCGAGAAGATGAYCCAGGTGA | Baraitser-Winter syndrome 1 |
| 587779775 | ACTB | NM_001101.3(ACTB): c.446C>T (p.Thr149Ile) | CCTCTGGCCGTACCAYTGGCATC | Baraitser-Winter syndrome 1 |
| 104894546 | ACTG1 | NM_001614.3(ACTG1): c.791C>T (p.Pro264Leu) | CCGGAGGCGCTGTTCCAGCYTTC | Deafness, autosomal dominant 20 |
| 281875325 | ACTG1 | NM_001614.3(ACTG1): c.359C>T (p.Thr120Ile) | CCAACAGAGAGAAGATGAYTCAG | Baraitser-Winter Syndrome 2, not provided |
| 11549190 | ACTG1 | NM_001614.3(ACTG1): c.404C>T (p.Ala135Val) | CCCCGGCCATGTACGTGGYCATC, CCCGGCCATGTACGTGGYCATCC, CCGGCCATGTACGTGGYCATCCA | Baraitser-Winter Syndrome 2, not provided |
| 78001248 | ACTG2 | NM_001615.3(ACTG2): c.532C>T (p.Arg178Cys) | CCTGCCCCATGCCATCATGYGCC, CCCCATGCCATCATGYGCCTGGA, CCCATGCCATCATGYGCCTGGAC | Visceral myopathy |
| 587777385 | ACTG2 | NM_001615.3(ACTG2): c.118C>T (p.Arg40Cys) | CCATTGTGGGCCGCCCTYGCCAC | Visceral myopathy |
| 387907345 | ACTN1 | NM_001130004.1(ACTN1): c.313G>A (p.Val105Ile) | GGCRTCAAACTGGTGTCCATCGG | Platelet-type bleeding disorder 15 |
| 794728966 | ACTN2 | NM_001103.3(ACTN2): c.2527-1G>A | CCARCCATACATCCTGGCGGAGG, TTCCCARCCATACATCCTGGCGG | Cardiomyopathy |
| 727502886 | ACTN2 | NM_001103.3(ACTN2): c.355G>A (p.Ala119Thr) | GGCRCTGAAGGTGAGAGGTGTGG, CCATTGGCRCTGAAGGTGAGAGG | Dilated cardiomyopathy IAA, Primary familial hypertrophic cardiomyopathy, Familial hypertrophic cardiomyopathy 23 |
| 121434437 | ACVR2B | NM_001106.3(ACVR2B): c.119G>A (p.Arg40His) | CTGGAGCRCACCAACCAGAGCGG | Heterotaxy, visceral, 4, autosomal |
| 28936687 | ACVRL1 | NM_000020.2(ACVRL1): c.632G>A (p.Gly211Asp) | AAGRCCGCTATGGCGAAGTGTGG | Pulmonary arterial hypertension related to hereditary hemorrhagic telangiectasia |
| 28936688 | ACVRL1 | NM_000020.2(ACVRL1): c.1031G>A (p.Cys344Tyr) | CAGTRTTGCATCGCCGACCTGGG, GCAGTRTTGCATCGCCGACCTGG | Hereditary hemorrhagic telangiectasia type 2, Pulmonary arterial hypertension related to hereditary hemorrhagic telangiectasia |
| 28936401 | ACVRL1 | NM_000020.2(ACVRL1): c.1120C>T (p.Arg374Trp) | CCCGAGAGTGGGCACCAAGYGGT, CCGAGAGTGGGCACCAAGYGGTA | Hereditary hemorrhagic telangiectasia type 2, Pulmonary arterial hypertension related to hereditary hemorrhagic telangiectasia |
| 121909288 | ACVRL1 | NM_000020.2(ACVRL1): c.1450C>T (p.Arg484Trp) | CCCGACTCACCGCGCTGYGGATC, CCGACTCACCGCGCTGYGGATCA | Hereditary hemorrhagic telangiectasia type 2, Pulmonary arterial hypertension related to hereditary hemorrhagic telangiectasia |
| 121908716 | ADA | NM_000022.2(ADA): c.632G>A (p.Arg211His) | TCACCRTACTGTCCACGCCGGGG, TTCACCRTACTGTCCACGCCGGG, ATTCACCRTACTGTCCACGCCGG | Severe combined immunodeficiency due to ADA deficiency |
| 121908723 | ADA | NM_000022.2(ADA): c.646G>A (p.Gly216Arg) | CCACGCCRGGGAGGTGGGCTCGG | Severe combined immunodeficiency due to ADA deficiency |
| 121908715 | ADA | NM_000022.2(ADA): c.986C>T (p.Ala329Val) | CCTTTCCAGAACATCAATGYGGC, CCAGAACATCAATGYGGCCAAAT | Severe combined immunodeficiency due to ADA deficiency |
| 121908735 | ADA | NM_000022.2(ADA): c.466C>T (p.Arg156Cys) | CCATCCTGTGCTGCATGYGCCAC | Severe combined immunodeficiency due to ADA deficiency |
| 121908736 | ADA | NM_000022.2(ADA): c.226C>T (p.Arg76Trp) | CCCTTCCCAGGGGCTGCYGGGAG, CCTTCCCAGGGGCTGCYGGGAGG | Severe combined immunodeficiency due to ADA deficiency, Partial adenosine deaminase deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 114025668 | ADA | NM_000022.2(ADA): c.643G>A (p.Ala215Thr) | CCGAGCCCACCTCCCCGGYGTGG | Severe combined immunodeficiency due to ADA deficiency, Partial adenosine deaminase deficiency |
| 121434358 | ADAMTS10 | NM_030957.3(ADAMTS10): c.73G>A (p.Ala25Thr) | ACGCACRCCTTCCGGTCTCAAGG | Weill-Marchesani syndrome 1 |
| 121434357 | ADAMTS10 | NM_030957.3(ADAMTS10): c.709C>T (p.Arg237Ter) | CCTGAAGCGATCGGTCAGCYGAG | Weill-Marchesani syndrome 1 |
| 786205077 | ADAMTS13 | NM_139025.4(ADAMTS13): c.414+1G>A | GCCTGAGRTAGGCATGGAGCTGG | Upshaw-Schulman syndrome |
| 281875305 | ADAMTS13 | NM_139025.4(ADAMTS13): c.1523G>A (p.Cys508Tyr) | GGTRTATGCCAAGTGGCCCCCGG | Upshaw-Schulman syndrome, not provided |
| 121908471 | ADAMTS13 | NM_139025.4(ADAMTS13): c.1193G>A (p.Arg398His) | TGCTCCCRCTCCTGCGGAGGAGG | Upshaw-Schulman syndrome |
| 121908474 | ADAMTS13 | NM_139025.4(ADAMTS13): c.3638G>A (p.Cys1213Tyr) | ACTRTGCAGTGGCCATTGGGCGG, CAGACTRTGCAGTGGCCATTGGG, GCAGACTRTGCAGTGGCCATTGG | Upshaw-Schulman syndrome |
| 786205078 | ADAMTS13 | NM_139025.4(ADAMTS13): c.331-1G>A | ACARGGGGCAGAACTGCTTCGGG, CACARGGGGCAGAACTGCTTCGG | Upshaw-Schulman syndrome |
| 11575933 | ADAMTS13 | NM_139025.4(ADAMTS13): c.1423C>T (p.Pro475Ser) | CCACTGGGGTGCTGCTGTAYCAC | Upshaw-Schulman syndrome |
| 121908469 | ADAMTS13 | NM_139025.4(ADAMTS13): c.304C>T (p.Arg102Cys) | CCAGGAGGACACAGAGYGCTATG | Upshaw-Schulman syndrome |
| 121908478 | ADAMTS13 | NM_139025.4(ADAMTS13): c.749C>T (p.Ala250Val) | CCCAGCGGACACGTGATGGYTTC, CCAGCGGACACGTGATGGYTTCG | Upshaw-Schulman syndrome |
| 267606638 | ADAMTS17 | NM_139057.2(ADAMTS17): c.760C>T (p.Gln254Ter) | CCACGGGGCCGAGGCCGCCYAGA | Weill-Marchesani-like syndrome |
| 137853147 | ADAMTS2 | NM_014244.4(ADAMTS2): c.2384G>A (p.Trp795Ter) | GGAGTRGGAGTACAGAGACGAGG | Ehlers-Danlos syndrome type 7, autosomal recessive |
| 137853146 | ADAMTS2 | NM_014244.4(ADAMTS2): c.673C>T (p.Gln225Ter) | CCCTCCTCTCGGGGGGCCAYAGG, CCTCCTCTCGGGGGGCCAYAGGC, CCTCTCGGGGGGCCAYAGGCCCT | Ehlers-Danlos syndrome type 7, autosomal recessive |
| 387907064 | ADAMTSL2 | NM_001145320.1 (ADAMTSL2):c.215G>A (p.Arg72Gln) | AGCRGCACTGCCTGCAGCAGAGG | Acromicric dysplasia |
| 113994121 | ADAMTSL2 | NM_001145320.1 (ADAMTSL2):c.440C>T (p.Pro147Leu) | CCACATCTCCAGCAAACYGTGTG | Acromicric dysplasia |
| 387907065 | ADAMTSL2 | NM_001145320.1 (ADAMTSL2):c.661C>T (p.Arg221Cys) | CCACGTGACGGGCAACTATYGCA | Acromicric dysplasia |
| 368482584 | ADAMTSL4 | NM_019032.5 (ADAMTSL4):c.2008C>T (p.Arg670Ter) | CCAGCTGCGTACTGGAAAYGAGT | Ectopia lentis, isolated autosomal recessive |
| 119468004 | ADCK3 | NM_020247.4(ADCK3): c.1651G>A (p.Glu551Lys) | CTACRAGGTCAAGGTGAGCAGGG, GCTACRAGGTCAAGGTGAGCAGG | Coenzyme Q10 deficiency, primary, 4 |
| 119468009 | ADCK3 | NM_020247.4(ADCK3): c.1645G>A (p.Gly549Ser) | CCTCACCRGCTACGAGGTCAAGG | Coenzyme Q10 deficiency, primary, 4 |
| 119468005 | ADCK3 | NM_020247.4(ADCK3): c.637C>T (p.Arg213Trp) | CCTGTGACGAGGATTGGCYGGCT | Coenzyme Q10 deficiency, primary, 4 |
| 398122981 | ADCK4 | NM_024876.3(ADCK4): c.1027C>T (p.Arg343Trp) | CCTAAGCCAGGACCTGYGGGAACC | Nephrotic syndrome, type 9 |
| 587777497 | ADCY1 | NM_021116.2(ADCY1): c.3112C>T (p.Arg1038Ter) | CCCCTACCACTTTGTGTGCYGAG, CCCTACCACTTTGTGTGCYGAGG, CCTACCACTTTGTGTGCYGAGGC | Deafness, autosomal recessive 44 |
| 757156390 | ADCY5 | NM_183357.2(ADCY5): c.1425C>G (p.Ile475Met) | AGCCCTCRATGTCAGCAAACAGG | Multiple congenital anomalies |
| 796065306 | ADCY5 | NM_183357.2(ADCY5): c.2176G>A (p.Ala726Thr) | TTGACRCCAGGAGCATTGATAGG | Dyskinesia, familial, with facial myokymia |
| 587783657 | ADGRG1 | NM_005682.6(ADGRG1): c.1970G>A (p.Trp657Ter) | TCATCTRGTACTGGTCCATGCGG | Polymicrogyria, bilateral frontoparietal |
| 587783660 | ADGRG1 | NM_005682.6(ADGRG1): c.620+1G>A | GCCARTAAGTTTGGCACCTGGGG, AGCCARTAAGTTTGGCACCTGGG, CAGCCARTAAGTTTGGCACCTGG | Polymicrogyria, bilateral frontoparietal |
| 121908464 | ADGRG1 | NM_005682.6(ADGRG1): c.1693C>T (p.Arg565Trp) | CCCGCAGGTGCTGGATCYGGGAC, CCGCAGGTGCTGGATCYGGGACT | Polymicrogyria, bilateral frontoparietal |
| 587783658 | ADGRG1 | NM_005682.6(ADGRG1): c.265C>T (p.His89Tyr) | CCCCAGGGGCCTCTACYACTTCT, CCCAGGGGCCTCTACYACTTCTG, CCAGGGGCCTCTACYACTTCTGC | Polymicrogyria, bilateral frontoparietal |
| 121909762 | ADGRV1 | NM_032119.3(ADGRV1): c.6901C>T (p.Gln2301Ter) | CCCCTGGGGAAACCATTYAAACC, CCCTGGGGAAACCATTYAAACCT, CCTGGGGAAACCATTYAAACCTT | Usher syndrome, type 2C |
| 28941471 | ADSL | NM_000026.2(ADSL): c.569G>A (p.Arg190Gln) | TCCRAGATGACCTGCGCTTCCGG | Adenylosuccinate lyase deficiency, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 202064195 | ADSL | NM_000026.2(ADSL): c.953C>T (p.Pro318Leu) | CCCTTGTCATGGACCYGCTACAG, CCTTGTCATGGACCYGCTACAGA | not provided |
| 750614500 | ADSL | NM_000026.2(ADSL): c.568C>T (p.Arg190Ter) | CCAGAACTTGAAGCGTGTCYGAG | not provided |
| 756210458 | ADSL | NM_000026.2(ADSL): c.421C>T (p.Arg141Trp) | CCAGAGTGATCTCTYGGCTTGCC | not provided |
| 786205680 | AFF4 | NM_014423.3(AFF4): c.772C>T (p.Arg258Trp) | CCCACTGCCTATGTGYGGCCCAT, CCACTGCCTATGTGYGGCCCATG | CHOPS SYNDROME |
| 727502823 | AFG3L2 | NM_006796.2(AFG3L2): c.1875G>A (p.Met625Ile) | AGGATRTGTATGACTTTAGGTGG, GATAGGATRTGTATGACTTTAGG | Spastic ataxia 5, autosomal recessive |
| 121434412 | AGPS | NM_003659.3(AGPS): c.926C>T (p.Thr309Ile) | CCCTGGAGTTCAGTAYTGTAGGA, CCTGGAGTTCAGTAYTGTAGGAG | Rhizomelic chondrodysplasia punctata type 3 |
| 74315283 | AGT | NM_000029.3(AGT): c.1124G>A (p.Arg375Gln) | TCTCCCCRGTAGGAGCCTCCCGG | Renal dysplasia |
| 121908522 | AGXT | NM_000030.2(AGXT): c.245G>A (p.Gly82Glu) | CTCGGRACACTGTGCCCTGGAGG, TGGCTCGGRACACTGTGCCCTGG | Primary hyperoxaluria, type I |
| 121908523 | AGXT | NM_000030.2(AGXT): c.121G>A (p.Gly41Arg) | GCCRGGGGCTGCAGATGATCGG | Primary hyperoxaluria, type I |
| 121908528 | AGXT | NM_000030.2(AGXT): c.738G>A (p.Trp246Ter) | AAGTGRCTGGCCAACTTCTGGGG, CAAGTGRCTGGCCAACTTCTGGG, TCAAGTGRCTGGCCAACTTCTGG | Primary hyperoxaluria, type I |
| 121908530 | AGXT | NM_000030.2(AGXT): c.466G>A (p.Gly156Arg) | ACCCACRGGGAGTCGTCCACCGG | Primary hyperoxaluria, type I |
| 180177161 | AGXT | NM_000030.2(AGXT): c.1079G>A (p.Arg360Gln) | GTGCTGCRGATCGGCCTGCTGGG, GGTGCTGCRGATCGGCCTGCTGG | Primary hyperoxaluria, type I |
| 180177162 | AGXT | NM_000030.2(AGXT): c.107G>A (p.Arg36His) | CTCRCATCATGGCAGCCGGGGGG, CCTCRCATCATGGCAGCCGGGGG, TCCTCRCATCATGGCAGCCGGGG, CCTCCTCRCATCATGGCAGCCGG | Primary hyperoxaluria, type I |
| 180177163 | AGXT | NM_000030.2(AGXT): c.1102G>A (p.Ala368Thr) | CAATRCCACCCGCGAGAATGTGG | Primary hyperoxaluria, type I |
| 180177170 | AGXT | NM_000030.2(AGXT): c.125G>A (p.Gly42Glu) | CCGGGGRGCTGCAGATGATCGGG, GCCGGGGRGCTGCAGATGATCGG | Primary hyperoxaluria, type I |
| 180177177 | AGXT | NM_000030.2(AGXT): c.166-1G>A | GCARATCATGGACGAGATCAAGG | Primary hyperoxaluria, type I |
| 180177196 | AGXT | NM_000030.2(AGXT): c.308G>A (p.Gly103Glu) | TTGRGGCCAATGGCATTTGGGGG, GTTGRGGCCAATGGCATTTGGGG, GGTTGRGGCCAATGGCATTTGGG, TGGTTGRGGCCAATGGCATTTGG | Primary hyperoxaluria, type I |
| 180177198 | AGXT | NM_000030.2(AGXT): c.323G>A (p.Trp108Ter) | CATTTRGGGCAGCGAGCCGTGG | Primary hyperoxaluria, type I |
| 180177231 | AGXT | NM_000030.2(AGXT): c.518G>A (p.Cys173Tyr) | AACTCTRCCACAGGTGAGCCTGG | Primary hyperoxaluria, type I |
| 180177235 | AGXT | NM_000030.2(AGXT): c.533G>A (p.Cys178Tyr) | GTACAAGTRCCTGCTCCTGGTGG | Primary hyperoxaluria, type I |
| 180177236 | AGXT | NM_000030.2(AGXT): c.547G>A (p.Asp183Asn) | GTGRATTCGGTGGCATCCCTGGG, GGTGRATTCGGTGGCATCCCTGG | Primary hyperoxaluria, type I |
| 61729604 | AGXT | NM_000030.2(AGXT): c.866G>A (p.Arg289His) | CAGCTGGCRCCAGCACCGCGAGG | Primary hyperoxaluria, type I, not provided |
| 180177210 | AGXT | NM_000030.2(AGXT): c.864C>T (p.Arg122Ter) | CCTGCACCCAGGAGCCYGAGTGC | Primary hyperoxaluria, type I |
| 180177279 | AGXT | NM_000030.2(AGXT): c.844C>T (p.Gln282Ter) | CCTGGCCCTCATTGCGGAAYAGG, CCCTCATTGCGGAAYAGGTGCAT | Primary hyperoxaluria, type I |
| 180177296 | AGXT | NM_000030.2(AGXT): c.922C>T (p.Gln308Ter) | CCTGCAGGCACTGGGGCTGYAGC | Primary hyperoxaluria, type I |
| 104894325 | AICDA | NM_020661.2(AICDA): c.203G>A (p.Trp68Ter) | TCGGACTRGGACCTAGACCCTGG | Immunodeficiency with hyper IgM type 2 |
| 104894324 | AICDA | NM_020661.2(AICDA): c.70C>T (p.Arg24Trp) | CCGCTGGGCTAAGGGTYGGCGTG | Immunodeficiency with hyper IgM type 2 |
| 104894190 | AIP | NM_003977.3(AIP): c.911G>A (p.Arg304Gln) | GAGCCRAGAGCTGCAGGCCCTGG | Pituitary dependent hypercortisolism |
| 104894194 | AIP | NM_003977.3(AIP): c.40C>T (p.Gln14Ter) | CCGGGAGGACGGGATCYAAAAAC | Somatotroph adenoma, Prolactinoma, familial, Pituitary adenoma predisposition |
| 267606541 | AIP | NM_003977.3(AIP): c.241C>T (p.Arg81Ter) | CCATCGTGTGCACCATGYGAGAA | Somatotroph adenoma |
| 62637014 | AIPL1 | NM_014336.4(AIPL1): c.834G>A (p.Trp278Ter) | GTGRAATGAGGCCGAGGCCAAGG | Leber congenital amaurosis 4, not provided |
| 61757484 | AIPL1 | NM_014336.4(AIPL1): c.1126C>T (p.Pro376Ser) | GACGRGGGTGGCTCTGTGGCTGG, TGGGACGRGGGTGGCTCTGTGG, CCCCTGCAGCCCCGCGCACYTGG, | Leber congenital amaurosis 4, not specified, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 142326926 | AIPL1 | NM_014336.4(AIPL1): c.784G>A (p.Gly262Ser) | CCCTGCAGCCCCGCGCACYTGGG, CCTGCAGCCCCGCGCACYTGGGT | Leber congenital amaurosis 4, not provided |
| 137853204 | AK1 | NM_000476.2(AK1): c.118G>A (p.Gly40Arg) | TCTCCACCRGGGACCTCCTGCGG | Adenylate kinase deficiency, hemolytic anemia due to |
| 137853205 | AK1 | NM_000476.2(AK1): c.190G>A (p.Gly64Arg) | GAAGRGGCAGCTGGTTCCACTGG | Adenylate kinase deficiency, hemolytic anemia due to |
| 104894101 | AK1 | NM_000476.2(AK1): c.382C>T (p.Arg128Trp) | CCCTGAGACCATGACCCAGYGGC, CCTGAGACCATGACCCAGYGGCT | Adenylate kinase deficiency, hemolytic anemia due to |
| 121918343 | AKR1D1 | NM_005989.3(AKR1D1): c.316C>T (p.Leu106Phe) | CCCAACCCTGGAGAGGACAYTCA, CCAACCCTGGAGAGGACAYTCAG, CCCTGGAGAGGACAYTCAGGGTC | Bile acid synthesis defect, congenital, 2 |
| 121434592 | AKT1 | NM_005163.2(AKT1): c.49G>A (p.Glu17Lys) | TAGGGRAGTACATCAAGACCTGG | Proteus syndrome, Carcinoma of colon, Breast adenocarcinoma, Neoplasm of ovary |
| 121434593 | AKT2 | NM_001626.5(AKT2): c.821G>A (p.Arg274His) | TACCRCGACATCAAGGTTAGTGG | Diabetes mellitus type 2 |
| 387906659 | AKT2 | NM_001626.5(AKT2): c.49G>A (p.Glu17Lys) | CAGGTRAATACATCAAGACCTGG | |
| 397514606 | AKT3 | NM_181690.2(AKT3): c.49G>A (p.Glu17Lys) | TAGGARAATATATAAAAAACTGG | Megalencephaly-polymicrogyria-polydactyly-hydrocephalus syndrome 2 |
| 121912981 | ALAD | NM_000031.5(ALAD): c.823G>A (p.Val275Met) | CTCGCCRTGTACCACGTCTCTGG | Porphobilinogen synthase deficiency |
| 121912983 | ALAD | NM_000031.5(ALAD): c.820G>A (p.Ala274Thr) | CTCRCCGTGTACCACGTCTCTGG | Porphobilinogen synthase deficiency |
| 749066913 | ALAD | NM_000031.5(ALAD): c.165-11C>T | GGTRTGGGTAGAGGGGTTGAAGG | Porphobilinogen synthase deficiency |
| 121912982 | ALAD | NM_000031.5(ALAD): c.718C>T (p.Arg240Trp) | CCCTCATCCCTTAGGACYGGGAT, CCTCATCCCTTAGGACYGGGATG | Porphobilinogen synthase deficiency |
| 137852302 | ALAS2 | NM_000032.4(ALAS2): c.871G>A (p.Gly291Ser) | ATCCAARGTATCCGTAACAGTGG | Hereditary sideroblastic anemia |
| 386834230 | ALDH1A3 | NM_000693.3(ALDH1A3): c.211G>A (p.Val71Met) | CGACRTGGACAAGGCTGTGGAGG, GCCCGACRTGGACAAGGCTGTGG | not provided |
| 397514652 | ALDH1A3 | NM_000693.3(ALDH1A3): c.265C>T (p.Arg89Cys) | CCAGAGGGGCTCGCCATGGYGCC | Microphthalmia, isolated 8 |
| 28939378 | ALG1 | NM_019109.4(ALG1): c.773C>T (p.Ser258Leu) | CCCAGTCACGGAGCGGTYGGCCT, CCAGTCACGGAGCGGTYGGCCTT | Congenital disorder of glycosylation type 1K, not provided |
| 121907933 | ALG12 | NM_024105.3(ALG12): c.301G>A (p.Gly101Arg) | GTTAGARGAGTGCTTGGACTCGG | Congenital disorder of glycosylation type 1G |
| 121907931 | ALG12 | NM_024105.3(ALG12): c.200C>T (p.Thr67Met) | CCCGGAGTCGTCCCCAGGAYGTT, CCGGAGTCGTCCCCAGGAYGTTC | Congenital disorder of glycosylation type 1G |
| 367570129 | ALG14 | NM_144988.3(ALG14): c.310C>T (p.Arg104Ter) | AATTCRGTGAATGTAGTATTTGG | Myasthenic syndrome, congenital, without tubular aggregates |
| 28940588 | ALG3 | NM_005787.5(ALG3): c.353G>A (p.Gly118Asp) | CCGAGRCACTGACATCCGCATGG | Congenital disorder of glycosylation type 1D |
| 387906273 | ALG3 | NM_005787.5(ALG3): c.165C>T (p.Gly55=) | CCTGGCGGAGGTGGGYATCACCT | Congenital disorder of glycosylation type 1D |
| 121908294 | ALG8 | NM_024079.4(ALG8): c.824G>A (p.Gly275Asp) | GGGRCCTCTGTCATGCATATTGG | Congenital disorder of glycosylation type 1H |
| 397514527 | ALOX12B | NM_001139.2(ALOX12B): c.1294C>T (p.Arg432Ter) | CCTCATCCCCCATACCYGATACA | Autosomal recessive congenital ichthyosis 2 |
| 397514531 | ALOX12B | NM_001139.2(ALOX12B): c.1207C>T (p.His403Tyr) | CCCACCTGCTGGAGACAYACCTC, CCACCTGCTGGAGACAYACCTCA | Autosomal recessive congenital ichthyosis 2 |
| 121434233 | ALOXE3 | NM_001165960.1 (ALOXE3):c.1096C>T (p.Arg366Ter) | CCTTGGGAATGAAGCTTYGAGGG | Autosomal recessive congenital ichthyosis 3 |
| 749544042 | ALPL | NM_000478.4(ALPL): c.648+1G>A | ACATTGACRTGAGTGCTCGGGGG | |
| 121918007 | ALPL | NM_000478.4(ALPL): c.571G>A (p.Glu191Lys) | AGACAACRAGATGCCCCCTGAGG | Childhood hypophosphatasia, Infantile hypophosphatasia, Adult hypophosphatasia |
| 121918009 | ALPL | NM_000478.4(ALPL): c.1001G>A (p.Gly334Asp) | AAGGAGRCAGAATTGACCACGGG, CAAGGAGRCAGAATTGACCACGG | Infantile hypophosphatasia |
| 121918013 | ALPL | NM_000478.4(ALPL): c.346G>A (p.Ala116Thr) | CGCCACCRCCTACCTGTGTGGGG, CCGCCACCRCCTACCTGTGTGGG | Childhood hypophosphatasia, Infantile hypophosphatasia, Adult hypophosphatasia, Odontohypophosphatasia |
| 121918019 | ALPL | NM_000478.4(ALPL): c.526G>A (p.Ala176Thr) | CAGCRCCGCCTACGCCCACTCGG | Childhood hypophosphatasia, Infantile hypophosphatasia |
| 121918015 | ALPL | NM_000478.4(ALPL): c.323C>T (p.Pro108Leu) | CCAATGCCCAGGTCCYTGACAGC | Odontohypophosphatasia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918020 | ALPL | NM_000478.4(ALPL): c.814C>T (p.Arg272Cys) | CCCACTTCATCTGGAACYGCACG, CCACTTCATCTGGAACYGCACGG | Childhood hypophosphatasia, Infantile hypophosphatasia |
| 1130335 | ALPP | NM_001632.3(ALPP): c.74C=(p.Pro25=) | CCCTGGGCATCATCCYAGGTAAT, CCTGGGCATCATCCYAGGTAATG | |
| 587776684 | ALX1 | NM_006982.2(ALX1): c.531+1G>A | TCCAGRTAGGAGCCAAAAAGAGG | Frontonasal dysplasia 3 |
| 121908168 | ALX3 | NM_006492.2(ALX3): c.547C>T (p.Arg183Trp) | CCTGATGTGTATGCCYGGGAGCA | Frontonasal dysplasia 1 |
| 387907269 | AMER1 | NM_152424.3(AMER1): c.811C>T (p.Gln271Ter) | CCTCAGCACATGTGYAACCCAAG | Osteopathia striata with cranial sclerosis |
| 121912682 | AMPD1 | NM_000036.2(AMPD1): c.1373G>A (p.Arg458His) | GAGCCCCRCCTGTCCATCTATGG | Muscle AMP deaminase deficiency, not provided |
| 121964981 | AMT | NM_000481.3(AMT): c.806G>A (p.Gly269Asp) | AGGCAGRCCTCTGCCTGTATGGG, GAGGCAGRCCTCTGCCTGTATGG | Non-ketotic hyperglycinemia |
| 36210415 | ANK2 | NM_001127493.1(ANK2): c.1360G>A (p.Gly454Arg) | CCGAGCCRGGCAGGTGGAAGTGG | Torsades de pointes |
| 1800497 | ANKK1 | NM_178510.1(ANKK1): c.2137G>A (p.Glu713Lys) | CCAGCTGGGCGCCTGCCTYGACC | Dopamine receptor d2, reduced brain density of |
| 137852512 | ANOS1 | NM_000216.2(ANOS1): c.711G>A (p.Trp237Ter) | TCACTGRCAGACAGTGGCCCAGG | Kallmann syndrome 1 |
| 137852514 | ANOS1 | NM_000216.2(ANOS1): c.774G>A (p.Trp258Ter) | CCGATGRTACCAGTTTCGAGTGG | Kallmann syndrome 1 |
| 137852516 | ANOS1 | NM_000216.2(ANOS1): c.84C>T (p.Arg262Ter) | CCGATGGTACCAGTTTYGAGTGG | Kallmann syndrome 1 |
| 137852517 | ANOS1 | NM_000216.2(ANOS1): c.1187C>T (p.Ser396Leu) | CCCTTCACTTCACATYGACACAT, CCTTCACTTCACATYGACACATG | Kallmann syndrome 1 |
| 397514700 | ANTXR1 | NM_032208.2(ANTXR1): c.505C>T (p.Arg169Ter) | CCAGGCTAATAGGTCTYAGAGAT, CCAGGCTAATAGGTCTYGAGATC | Odontotrichomelic syndrome |
| 587776739 | AP1S2 | NM_003916.4(AP1S2): c.288+5G>A | CCTAAAATAAAATACTAYTCACA | Mental retardation X-linked syndromic 5 |
| 397514498 | AP2S1 | NM_004069.4(AP2S1): c.43C>T (p.Arg15Cys) | CCGGGCAGGCAAGACGYGCCTGG | Hypocalciuric hypercalcemia, familial, type 3 |
| 730882249 | AP4M1 | NM_004722.3(AP4M1): c.952C>T (p.Arg318Ter) | CCAGGTTTATCTAAAGTTGYGAT | Microcephaly, Hypoplasia of the corpus callosum, Spastic paraplegia 50, autosomal recessive, Global developmental delay, CNS hypomyelination, Brain atrophy |
| 587781392 | APC | NM_000038.5(APC): c.637C>T (p.Arg213Ter) | CCAGGATATGGAAAAAYGAGCAC | Hereditary cancer-predisposing syndrome, not provided |
| 121913327 | APC | NM_000038.5(APC): c.4012C>T (p.Gln1338Ter) | CCAAATCCAGCAGACTGYAGGGT | Familial adenomatous polyposis 1, Carcinoma of colon |
| 587783029 | APC | NM_000038.5(APC): c.3286C>T (p.Gln1096Ter) | CCAACCACATTTTGGACAGYAGG, CCACATTTTGGACAGYAGGAATG | Familial adenomatous polyposis 1, not provided |
| 121909576 | APOA4 | NM_000482.3(APOA4): c.748G>A (p.Glu250Lys) | ACGCCRAGGAGCTCAAGGCCAGG | |
| 121918390 | APOB | NM_000384.2(APOB): c.7564C>T (p.Arg2522Ter) | CCTAGAAGATACACGAGACYGAA | Hypobetalipoproteinemia, familial, associated with apob32 |
| 138326449 | APOC3 | NM_000040.1(APOC3): c.55+1G>A | TCTGCCCRTAAGCACTTGGTGGG, CTCTGCCCRTAAGCACTTGGTGG | Coronary heart disease, Hyperalphalipoproteinemia 2 |
| 28931577 | APOE | NM_000041.3(APOE): c.349G>A (p.Ala117Thr) | CAGRCGGCGCAGGCCCGGCTGGG, GCAGRCGGCGCAGGCCCGGCTGG, AGCTGCAGRCGGCGCAGGCCCGG | |
| 121918398 | APOE | NM_000041.3(APOE): c.875G>A (p.Arg292His) | GCAGRCCAGTGGGCCGGGCTGG | |
| 267606664 | APOE | NM_000041.3(APOE): c.434G>A (p.Gly145Asp) | CATGCTCGRCCAGAGCACCGAGG | |
| 7412 | APOE | NM_000041.2(APOE): c.526C>T (p.Arg176Cys) | CCGATGACCTGCAGAAGYGCCTG | Familial type 3 hyperlipoproteinemia |
| 769455 | APOE | NM_000041.3(APOE): c.487C>T (p.Arg163Cys) | CCCACCTGCGCAAGCTGYGTAAG, CCACCTGCGCAAGCTGYGTAAGC | Familial type 3 hyperlipoproteinemia |
| 387906567 | APOE | NM_000041.3(APOE): c.478C>T (p.Arg160Cys) | CCTCGCCTCCCACCTGYGCAAGC | Familial type 3 hyperlipoproteinemia |
| 63749810 | APP | NM_000484.3(APP): c.2080G>A (p.Asp694Asn) | GAARATGTGGGTTCAAACAAAGG | Cerebral amyloid angiopathy, APP-related, not provided |
| 63750734 | APP | NM_000484.3(APP): c.2143G>A (p.Val715Met) | GACARTGATCGTCATCACCTTGG | Alzheimer disease, type 1, not provided |
| 104894507 | APRT | NM_000485.2(APRT): c.294G>A (p.Trp98Ter) | TCTGTGRGCCTCCTATTCCCTG | Adenine phosphoribosyltransferase deficiency |
| 121908131 | APTX | NM_175073.2(APTX): c.617C>T (p.Pro206Leu) | CCATTGGCTGGTCTTACYGTGGA | Adult onset ataxia with oculomotor apraxia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894004 | AQP1 | NM_198098.2(AQP1): c.113C>T (p.Pro38Leu) | CCCTGGGCTTCAAATACCYGGTG, CCTGGGCTTCAAATACCYGGTGG | |
| 368292687 | AQP5 | NM_001651.3(AQP5): c.562C>T (p.Arg188Cys) | CCATGAACCCAGCCYGCTCTTTT | Diffuse palmoplantar keratoderma, Bothnian type |
| 104894742 | AR | NM_000044.3(AR): c.4G>A (p.Glu2Lys) | ATGRAAGTGCAGTTAGGGCTGGG, GATGRAAGTGCAGTTAGGGCTGG, CAAGGATGRAAGTGCAGTTAGGG | Reifenstein syndrome |
| 137852563 | AR | NM_000044.3(AR): c.2157G>A (p.Trp719Ter) | AAGTGRGCCAAGGCCTTGCCTGG | |
| 137852571 | AR | NM_000044.3 (AR): c.2191G>A (p.Val731Met) | CTTACACRTGGACGACCAGATGG | Malignant tumor of prostate |
| 137852572 | AR | NM_000044.3(AR): c.2324G>A (p.Arg775His) | GGTACCRCATGCACAAGTCCCGG | |
| 137852583 | AR | NM_000044.3(AR): c.2164G>A (p.Ala722Thr) | GGCCAAGRCCTTGCCTGGTAAGG | Malignant tumor of prostate |
| 137852588 | AR | NM_000044.3(AR): c.1645C>T (p.Pro549Ser) | CCAGGGACCATGTTTTGYCCATT | Hypospadias 1, X-linked |
| 28940281 | ARHGEF10 | NM_014629.3(ARHGEF10): c.995C>T (p.Thr332Ile) | CCGCGAAGGACGGCAYCAAGGAC | Slowed nerve conduction velocity, autosomal dominant |
| 587779745 | ARID1B | NM_020732.3(ARID1B): c.4102C>T (p.Gln1368Ter) | CCAGCCCGGCCTGTACCCAYAGC, CCCGGCCTGTACCCAYAGCAGCC, CCGGCCTGTACCCAYAGCAGCG | Coffin Siris/Intellectual Disability |
| 387907140 | ARID1B | NM_020732.3(ARID1B): c.3919C>T (p.Gln1307Ter) | CCAACAGCAGCATGYAGGACAT, CCAACAGCAGCATGYAGGACATG | Mental retardation, autosomal dominant 12 |
| 387907141 | ARID1B | NM_020732.3(ARID1B): c.3304C>T (p.Arg1102Ter) | CCCCTGGACCTGTTCYGACTCTA, CCCTGGACCTGTTCYGACTCTAC | Mental retardation, autosomal dominant 12 |
| 369721476 | ARMC5 | NM_001288767.1(ARMC5): c.1084C>T (p.Arg362Ter) | CCCTCCTGGAACTCAGCYGAGGC, CCTCCTGGAACTCAGCYGAGGCT | Acth-independent macronodular adrenal hyperplasia 2 |
| 199476366 | ARSA | NM_000487.5(ARSA): c.737G>A (p.Arg246His) | TTCAGGCCRCGGGCCATTTGGGG | Metachromatic leukodystrophy, not provided |
| 74315461 | ARSA | NM_000487.5(ARSA): c.370G>A (p.Gly124Ser) | GGCCRGCAAGTGGCACCTTGGGG, TGGCCRGCAAGTGGCACCTTGGG, ATGGCCRGCAAGTGGCACCTTGG | Metachromatic leukodystrophy, not provided |
| 80338815 | ARSA | NM_000487.5(ARSA): c.465+1G>A | CGACCAGRTAGGAACCACCCGGG, ACGACCAGRTAGGAACCACCCGG | Metachromatic leukodystrophy, Metachromatic leukodystrophy, juvenile type, Metachromatic leukodystrophy, adult type |
| 80338820 | ARSA | NM_000487.5(ARSA): c.1210+1G>A | CCCAGGRTAACCCCTCCCCGTGG | Metachromatic leukodystrophy, Metachromatic leukodystrophy, juvenile type |
| 74315458 | ARSA | NM_000487.5(ARSA): c.257G>A (p.Arg86Gln) | GTTCRGATGGGCATGTACCCTGG | Metachromatic leukodystrophy |
| 74315483 | ARSA | NM_000487.5(ARSA): c.763G>A (p.Glu255Lys) | ATGRAGCTGGATGCAGCTGTGGG, GATGRAGCTGGATGCAGCTGTGG | Metachromatic leukodystrophy, Metachromatic leukodystrophy, late infantile |
| 74315456 | ARSA | NM_000487.5(ARSA): c.293C>T (p.Ser98Phe) | CCTGGTGCCCAGCTYCCGGGGGG | Metachromatic leukodystrophy, Metachromatic leukodystrophy, late infantile |
| 74315462 | ARSA | NM_000487.5(ARSA): c.413C>T (p.Pro138Leu) | CCTGAGGGGGCCTTCCTGCYCCC | |
| 398123418 | ARSA | NM_000487.5(ARSA): c.986C>T (p.Thr329Ile) | CCTGCCCCAGGCGTGAYCCACG | Metachromatic leukodystrophy |
| 74315468 | ARSA | NM_000487.5(ARSA): c.677C>T (p.Ala226Val) | CCCTTCTTCCTGTACTATGYCTC, CCTTCTTCCTGTACTATGYCTCT | Metachromatic leukodystrophy |
| 74315473 | ARSA | NM_000487.5(ARSA): c.868C>T (p.Arg290Cys) | CCCAGACCTGAGACCATGYGTAT, CCAGACCTGAGACCATGYGTATG | Metachromatic leukodystrophy |
| 74315481 | ARSA | NM_000487.5(ARSA): c.1232C>T (p.Thr411Ile) | CCCACAGTGATACCAYTGCAGAC, CCACAGTGATACCAYTGCAGACC | Metachromatic leukodystrophy |
| 118203941 | ARSB | NM_000046.3(ARSB): c.1214G>A (p.Cys405Tyr) | CCCAGRTCCCAGGAACAGCATGG | Mucopolysaccharidosis type VI, MUCOPOLYSACCHARIDOSIS, TYPE VI, SEVERE |
| 118203942 | ARSB | NM_000046.3(ARSB): c.284G>A (p.Arg95Gln) | TCGCRGAGCCAGCTGCTCACTGG | Mucopolysaccharidosis type VI, not provided |
| 122460155 | ARSE | NM_000047.2(ARSE): c.1475G>A (p.Cys492Tyr) | CGGTGCCTRCTATGGAAGAAAGG | Chondrodysplasia punctata 1, X-linked recessive |
| 28935474 | ARSE | NM_000047.2(ARSE): c.1732C>T (p.Pro578Ser) | CCCTGCTGTGGCCCGTTCYCCCT, CCTGCTGTGGCCCGTTCYCCCTC | Chondrodysplasia punctata 1, X-linked recessive |
| 587783096 | ARX | NM_139058.2(ARX): c.1141G>A (p.Ala381Thr) | TCGCRGCCAAGTGGCGCAAGCGG, GTCGGRCCAAGTGGCGCAAGCGG | not provided |
| 104894740 | ARX | NM_139058.2(ARX): c.1117C>T (p.Gln373Ter) | CCGAGGCCCGAGTCYAGGTGAGC | Lissencephaly 2, X-linked |
| 104894743 | ARX | NM_139058.2(ARX): c.1058C>T (p.Pro353Leu) | CCAGAAGACGCACTACCYGGACG | Epileptic encephalopathy, early infantile, 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783189 | ARX | NM_139058.2(ARX): c.1414C>T (p.Arg472Ter) | CCTCGGAGCGGCAGTGTTCYGAC | Lissencephaly 2, X-linked |
| 145873635 | ASAH1 | NM_004315.4(ASAH1): c.173C>T (p.Thr58Met) | ACTCACRTTGGTCCTGAAGGAGG | Jankovic Rivera syndrome |
| 104886478 | ASB10 | NM_080871.3(ASB10): c.765C>T (p.Thr255=) | CCGATGCCGAGGCCACCACYGCC | Glaucoma 1, open angle, F |
| 145138923 | ASL | NM_000048.3(ASL): c.35G>A (p.Arg12Gln) | TGGCCRGTTTGTGGGTGCAGTGG | Argininosuccinate lyase deficiency, not provided |
| 142637046 | ASL | NM_000048.3(ASL): c.446+1G>A | GCAGAGGCRTGAGTCCTACAGGG | not provided |
| 28940286 | ASL | NM_001024943.1(ASL): c.1153C>T (p.Arg385Cys) | CCCAGATGCCATTCYGCCAGGCC | Argininosuccinate lyase deficiency |
| 398123126 | ASL | NM_000048.3(ASL): c.544C>T (p.Arg182Ter) | CCACGCCGTGGCACTGACCYGAG, CCGTGGCACTGACCYGAGACTCT | Argininosuccinate lyase deficiency, not provided |
| 374304304 | ASL | NM_000048.3(ASL): c.280C>T (p.Arg94Cys) | CCACACAGCCAATGAGYGCCGCC | Argininosuccinate lyase deficiency, not provided |
| 398122974 | ASNS | NM_183356.3(ASNS): c.1648C>T (p.Arg550Cys) | CCACTGACCCTTCTGCCYGCACG | Asparagine synthetase deficiency, Abnormality of neuronal migration |
| 199422154 | ASPM | NM_018136.4(ASPM): c.3082G>A (p.Gly1028Arg) | GCATRGTAAAAACTGAGTAGAGG | Primary autosomal recessive microcephaly 5 |
| 587783287 | ASPM | NM_018136.4(ASPM): c.9091C>T (p.Arg3031Ter) | CCTTATAGAGACATYGAGCTGCT | Primary autosomal recessive microcephaly 5 |
| 587783227 | ASPM | NM_018136.4(ASPM): c.2791C>T (p.Arg931Ter) | CCTTTTGGCTTTTTCAYGAGATT | Primary autosomal recessive microcephaly 5 |
| 587783275 | ASPM | NM_018136.4(ASPM): c.8017C>T (p.Gln2673Ter) | CCAAGCAGTTATTTGTATAYAGT | Primary autosomal recessive microcephaly 5 |
| 199422148 | ASPM | NM_018136.4(ASPM): c.1990C>T (p.Gln664Ter) | CCCATTATCGCTGTGGCAYAGTC, CCATTATCGCTGTGGCAYAGTCC | Primary autosomal recessive microcephaly 5 |
| 199422175 | ASPM | NM_018136.4(ASPM): c.7894C>T (p.Gln2632Ter) | CCAGGCTGCCATTATTATTYAGA | Primary autosomal recessive microcephaly 5 |
| 137852996 | ASPM | NM_018136.4(ASPM): c.349C>T (p.Arg117Ter) | CCACTCAAAGAAGGCYGAGTAAG | Primary autosomal recessive microcephaly 5 |
| 121908637 | ASS1 | NM_000050.4(ASS1): c.470G>A (p.Arg157His) | CAAGGGCCRCAATGACCTGATGG | Citrullinemia type I, not provided |
| 121908639 | ASS1 | NM_000050.4(ASS1): c.970G>A (p.Gly324Ser) | TACCRGTGCGTAAGACTCTATGG | Citrullinemia type I, not provided |
| 777828000 | ASS1 | NM_000050.4(ASS1): c.571G>A (p.Glu191Lys) | CAGCTACRAGGCTGGAATCCTGG | Citrullinemia type I |
| 398123131 | ASS1 | NM_000050.4(ASS1): c.794G>A (p.Arg265His) | CGTGGGCCRTATTGACATCGTGG | Citrullinemia type I, not provided |
| 786204537 | ASS1 | NM_000050.4(ASS1): c.1030C>T (p.Arg344Ter) | CCAAGTCCCAGGAGYGAGTGGAA | Citrullinemia type I, not provided |
| 138350285 | ASS1 | NM_000050.4(ASS1): c.-4C>T | CCTCGACTCCCGCCAGAYGCTAT | not provided |
| 121908640 | ASS1 | NM_000050.4(ASS1): c.1087C>T (p.Arg363Trp) | CCAGGTGTACATCCTCGGCYGGG | Citrullinemia type I, not provided |
| 121908642 | ASS1 | NM_000050.4(ASS1): c.910C>T (p.Arg304Trp) | CCTTCACCATGGACYGGGAAGTG | Citrullinemia type I |
| 373145711 | ASXL1 | NM_015338.5(ASXL1): c.1210C>T (p.Arg404Ter) | CCAGCCACCCGACAGYGAGATGG | C-like syndrome |
| 387907077 | ASXL1 | NM_015338.5(ASXL1): c.2773C>T (p.Gln925Ter) | CCATCTGTTGAGCCCYAGGTTGG | C-like syndrome |
| 587777061 | ASXL3 | NM_030632.1(ASXL3): c.1210C>T (p.Gln404Ter) | CCTTGGCAGAACAAYAGCCAAAA | Bainbridge-Ropers syndrome |
| 761357250 | ATF6 | NM_007348.3(ATF6): c.970C>T (p.Arg324Cys) | CCGCTTGTCAGTCTYGCAAGAAG | Achromatopsia 7 |
| 119476046 | ATL1 | NM_015915.4(ATL1): c.715C>T (p.Arg239Cys) | CCAAATTCTTGGAAAAYGCCTC | Spastic paraplegia 3 |
| 137852657 | ATL1 | NM_015915.4(ATL1): c.467C>T (p.Thr156Ile) | CCTTTGATAGTCAGTCAAYTTTG | Spastic paraplegia 3 |
| 587779818 | ATM | NM_000051.3(ATM): c.170G>A (p.Trp57Ter) | TGAATTRGGATGCTGTTTTTAGG | Ataxia-telangiectasia syndrome, Hereditary cancer-predisposing syndrome |
| 786201957 | ATM | NM_000051.3(ATM): c.3349C>T (p.Gln1117Ter) | CCTTTGAAGCTTCAGYAAACAGC | Hereditary cancer-predisposing syndrome |
| 199624796 | ATP13A2 | NM_022089.3(ATP13A2): c.490C>T (p.Arg164Trp) | ATACCRCAGCACCCGCTTCTGGG, AATACCRCAGCACCCGCTTCTGG | Parkinson disease 9 |
| 121918616 | ATP1A2 | NM_000702.3(ATP1A2): c.1643G>A (p.Arg548His) | GGGAGCRTGTGCTGGGTGAGAGG | Migraine, familial basilar |
| 796052276 | ATP1A2 | NM_000702.3(ATP1A2): c.1091C>T (p.Thr364Met) | CCTGGAGGCGGTGGAGAYGCTGG | not provided |
| 121918615 | ATP1A2 | NM_000702.3(ATP1A2): c.2936C>T (p.Pro979Leu) | CCCTCCGCATGTACCYGCTCAAG, CCTCCGCATGTACCYGCTCAAGT | Familial hemiplegic migraine type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918620 | ATP1A2 | NM_000702.3(ATP1A2): c.1127C>T (p.Thr376Met) | CCATCTGCTCGGACAAGAYGGGC | Familial hemiplegic migraine type 2 |
| 80356534 | ATP1A3 | NM_152296.4(ATP1A3): c.1838C>T (p.Thr613Met) | CCGGCGATCACCCCATCAYGGCC | Dystonia 12 |
| 121918113 | ATP2A1 | NM_004320.4(ATP2A1): c.592C>T (p.Arg198Ter) | CCCGTTCCTGACCCCYGAGCTGT, CCGTTCCTGACCCCYGAGCTGTC | Brody myopathy |
| 121918115 | ATP2A1 | NM_004320.4(ATP2A1): c.2366C>T (p.Pro789Leu) | CCTGAGGCCCTGATCCYGGTGCA | Brody myopathy |
| 121912736 | ATP2A2 | NM_001681.3(ATP2A2): c.2305G>A (p.Gly769Arg) | CGTCRGGGAAGTTGTCTGGTAGG, CCAACGTCRGGGAAGTTGTCTGG | Darier disease, segmental |
| 28929478 | ATP2A2 | NM_001681.3(ATP2A2): c.68G>A (p.Gly23Glu) | TACGGRGCTGAGCCTGGAACAGG | Keratosis follicularis |
| 137853012 | ATP2C1 | NM_001001486.1(ATP2C1): c.910G>A (p.Ala304Thr) | GCTGTARCAGCAATTCCTGAAGG | Familial benign pemphigus |
| 121918521 | ATP6AP2 | NM_005765.2(ATP6AP2): c.321C>T (p.Asp107=) | CCTTTTAGTCTTGAYAGTGTTGC | Mental retardation, X-linked, syndromic, Hedera type |
| 374480381 | A2ATP6V0 | NM_012463.3(ATP6V0A2): c.1514+1G>A | GGAARTAAGTGTCCCATAGCTGG | Cutis laxa with osteodystrophy, not provided |
| 28939081 | ATP6V0A4 | NM_020632.2(ATP6V0A4): c.2420G>A (p.Arg807Gln) | TGCRACTGCACTGGTAAGGATGG, GCCCTGCRACTGCACTGGTAAGG | Renal tubular acidosis, distal, autosomal recessive, with late-onset sensorineural hearing loss |
| 121908367 | ATP6V0A4 | NM_020632.2(ATP6V0A4): c.2257C>T (p.Gln753Ter) | CCTCAGCCTGGCTCATGCAYGTG | Renal tubular acidosis, distal, autosomal recessive |
| 121908368 | ATP6V0A4 | NM_020632.2(ATP6V0A4): c.1571C>T (p.Pro524Leu) | CCCGTTTGGGATTGATCYGGTAA, CCGTTTGGGATTGATCYGGTAAT | Renal tubular acidosis, distal, autosomal recessive |
| 121964881 | ATP6V1B1 | NM_001692.3(ATP6V1B1): c.232G>A (p.Gly78Arg) | GAGCRGGCAGGTGCTTGAGGTGG, GAGGAGCRGGCAGGTGCTTGAGG | |
| 794729667 | ATP6V1B2 | NM_001693.3(ATP6V1B2): c.1516C>T (p.Arg506Ter) | CCTCAGCGAATTTTACCCYTGAG | Zimmermann-Laband syndrome 2 |
| 267606673 | ATP7A | NM_000052.6(ATP7A): c.2981C>T (p.Thr994Ile) | CCAAGCCTCTATCAYAGTTCTGT | Distal spinal muscular atrophy, X-linked 3 |
| 201038679 | ATP7B | NM_000053.3(ATP7B): c.2975C>T (p.Pro992Leu) | CGTGRGCGTGGCCAGCCCCAGGG, CCGTGRGCGTGGCCAGCCCCAGG | Wilson disease |
| 28942076 | ATP7B | NM_000053.3(ATP7B): c.2827G>A (p.Gly943Ser) | GTAATCRGTTTTATCGATTTTGG | Wilson disease |
| 137853283 | ATP7B | NM_000053.3(ATP7B): c.2336G>A (p.Trp779Ter) | GGGCCGGTRGCTGGAACACTTGG | Wilson disease |
| 587783306 | ATP7B | NM_000053.3(ATP7B): c.2865+1G>A | TCCTRTAAGTTGAATGCCTTGGG, TTCCTRTAAGTTGAATGCCTTGG | Wilson disease |
| 72552255 | ATP7B | NM_000053.3(ATP7B): c.2930C>T (p.Thr977Met) | CCGGAACCCAAGTTCRTCACGTT | Wilson disease, not provided |
| 121907994 | ATP7B | NM_000053.3(ATP7B): c.2621C>T (p.Ala874Val) | CCCGGAAGCACTGTAATTGYGGG, CCGGAAGCACTGTAATTGYGGGG | Wilson disease |
| 121909101 | ATP8B1 | NM_005603.4(ATP8B1): c.1660G>A (p.Asp554Asn) | CTCTCCCRATGAAGGTGCCCTGG | Progressive intrahepatic cholestasis |
| 122445104 | ATRX | NM_000489.4(ATRX): c.5225G>A (p.Arg1742Lys) | AGGARGAGGATTATTTTAACAGG | ATR-X syndrome |
| 122445099 | ATRX | NM_000489.4(ATRX): c.7156C>T (p.Arg2386Ter) | CCAGGAGCTTGATGTTAAAYGAA | ATR-X syndrome |
| 730880309 | AUH | NM_001698.2(AUH): c.895-1G>A | CTCARGTCGATTTAGTAACAGGG, TCTCARGTCGATTTAGTAACAGG | 3-Methylglutaconic aciduria |
| 121908654 | AURKC | NM_001015879.1(AURKC): c.629G>A (p.Cys210Tyr) | CTCTRCTATGAGCTGCTGGTGGG, GCTCTRCTATGAGCTGCTGGTGG, AGTGCTCTRCTATGAGCTGCTGG | Infertility associated with multi-tailed spermatozoa and excessive DNA |
| 121964882 | AVP | NM_000490.4(AVP): c.262G>A (p.Gly88Ser) | AGTCCRGCCAGAGGCGTGCGGG, CAGTCCRGCCAGAGGCGTGCGG | Neurohypophyseal diabetes insipidus |
| 121964890 | AVP | NM_000490.4(AVP): c.260C>T (p.Ser87Phe) | CCGTCGCCCTGCCAGTYCGGCCA | Neurohypophyseal diabetes insipidus |
| 121964892 | AVP | NM_000490.4(AVP): c.20C>T (p.Pro7Leu) | CCTGACACCATGCTGCYCGCCTG | |
| 28935496 | AVPR2 | NM_000054.4(AVPR2): c.337C>T (p.Arg113Trp) | CCAGATGCCCTGTGTYGGGCCGT | Nephrogenic diabetes insipidus, X-linked |
| 104894760 | AVPR2 | NM_000054.4(AVPR2): c.310C>T (p.Arg104Cys) | CCTGGAAGGCCACCGACYGCTTC | Nephrogenic diabetes insipidus, Nephrogenic diabetes insipidus, X-linked |
| 730882193 | AXIN2 | NM_004655.3(AXIN2): c.1989G>A (p.Trp663Ter) | ATCTGTGRGGGGGCAACAGCGGG, CATCTGTGRGGGGGCAACAGCGG | Oligodontia-colorectal cancer syndrome |
| 121908568 | AXIN2 | NM_004655.3(AXIN2): c.1966C>T (p.Arg656Ter) | CCGCTCGTCTCCAGGCGAAYGAG | Oligodontia-colorectal cancer syndrome |
| 367543074 | B3GALNT2 | NM_152490.4(B3GALNT2): c.802G>A (p.Val268Met) | GGTRTGGAGGGAGTTGCAGGTGG, GAAGGTRTGGAGGGAGTTGCAGG | Congenital muscular dystrophy-dystroglycanopathy with brain and eye anomalies, type AII, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397514722 | B3GALT6 | NM_080605.3(B3GALT6): c.16C>T (p.Arg6Trp) | CGCCCRCCGCAGCAGCTTCATGG | Ehlers-Danlos syndrome, progeroid type, 2 |
| 397514724 | B3GALT6 | NM_080605.3(B3GALT6): c.649G>A (p.Gly217Ser) | CCGAGAGCACGTAGCYGCCGCCC | |
| 387906876 | BAG3 | NM_004281.3(BAG3): c.1430G>A (p.Arg477His) | GTGCRTCAGGCCAGGAGAGACGG | Dilated cardiomyopathy 1HH |
| 387906874 | BAG3 | NM_004281.3(BAG3): c.211C>T (p.Arg71Trp) | CCAATGGCCCTTCCYGGGAGGGC | Dilated cardiomyopathy 1HH, not provided |
| 387906871 | BANF1 | NM_003860.3(BANF1): c.34G>A (p.Ala12Thr) | CTTCGTGRCAGAGCCCATGGGGG, ACTTCGTGRCAGAGCCCATGGGG | Nestor-Guillermo progeria syndrome |
| 786202118 | BARD1 | NM_000465.3(BARD1): c.2268G>A (p.Trp756Ter) | TCTGRAAGGCTCCTTCGAGCTGG | Hereditary cancer-predisposing syndrome |
| 587777829 | BBS1 | NM_024649.4(BBS1): c.432+1G>A | AAGAGRTAAATAAATAACATGGG, AAAGAGRTAAATAAATAACATGG | Bardet-Biedl syndrome, Bardet-Biedl syndrome 1 |
| 121908178 | BBS2 | NM_031885.3(BBS2): c.943C>T (p.Arg315Trp) | CCTTCTGTTCAGTCYGGGGCTAC | |
| 121908180 | BBS2 | NM_031885.3(BBS2): c.646C>T (p.Arg216Ter) | CCCATGTATGGCAGTYGATTTGG, CCATGTATGGCAGTYGATTTGGT | |
| 119466002 | BBS7 | NM_176824.2(BBS7): c.632C>T (p.Thr211Ile) | CCTTTTGTTTGGGAYATCAGACG | Bardet-Biedl syndrome |
| 121918133 | BCAM | NM_005581.4(BCAM): c.361C>T (p.Arg121Ter) | CCCAGGTGGGCGACGAGYGAGAC, CCAGGTGGGCGACGAGYGAGACT | |
| 375785084 | BCKDHA | NM_000709.3(BCKDHA): c.659C>T (p.Ala220Val) | CCTGCAGCGGTGGGGGCGGYGTA | Maple syrup urine disease, not provided |
| 398123497 | BCKDHA | NM_000709.3(BCKDHA): c.288+9C>T | CCCCCACGTGAGAGGYGGCCTCC, CCCCACGTGAGAGGYGGCCTCCC | Maple syrup urine disease, not provided |
| 398123503 | BCKDHA | NM_000709.3(BCKDHA): c.632C>T (p.Thr211Met) | CCTCTCCACTGGCCAYGCAGATC | Maple syrup urine disease, not provided |
| 137852873 | BCKDHA | NM_000709.3(BCKDHA): c.793C>T (p.Arg265Trp) | CCCCATCATCTTCTTCTGCYGGA, CCATCATCTTCTTCTGCYGGAA, CCATCATCTTCTTCTGCYGGAAC | Maple syrup urine disease, type 1A |
| 398124602 | BCKDHB | NM_000056.3(BCKDHB): c.952-1G>A | TTCARTCTGTGATCAAAACAGGG, TTTCARTCTGTGATCAAAACAGG | Maple syrup urine disease, not provided |
| 121965004 | BCKDHB | NM_000056.3(BCKDHB): c.616C>T (p.His206Tyr) | CCTGAAGCATTTTTTGCCYATTG | |
| 397514573 | BCKDK | NM_005881.3(BCKDK): c.466C>T (p.Arg156Ter) | CCAGTACTGCCAGCTGGTGYGAC | Branched-chain ketoacid dehydrogenase kinase deficiency |
| 121908571 | BCS1L | NM_004328.4(BCS1L): c.830G>A (p.Ser277Asn) | GCAGARCCTGGTACTCCTGGAGG, GCAGCAGARCCTGGTACTCCTGG | Mitochondrial complex III deficiency |
| 121908578 | BCS1L | NM_004328.4(BCS1L): c.550C>T (p.Arg184Cys) | CCCTTTGGCTATCCACGCYGCCG, CCTTTGGCTATCCACGCYGCCGG | Mitochondrial complex III deficiency |
| 28940276 | BEST1 | NM_004183.3(BEST1): c.25G>A (p.Val9Met) | CAARTGGCTAATGCCCGCTTAGG | Vitelliform dystrophy, not provided |
| 121918287 | BEST1 | NM_004183.3(BEST1): c.949G>A (p.Val317Met) | CCAGRTGTCCCTGTTGGCTGTGG | Bestrophinopathy, autosomal recessive |
| 28940570 | BEST1 | NM_004183.3(BEST1): c.728C>T (p.Ala243Val) | CCCAGGTGGTGACTGTGGYGGTG, CCAGGTGGTGACTGTGGYGGTGT | Vitelliform dystrophy, not provided |
| 372989281 | BEST1 | NM_004183.3(BEST1): c.763C>T (p.Arg255Trp) | CCTGACTTGTCTAGTTGGGYGGC | Retinitis pigmentosa |
| 398123028 | BICD2 | NM_015250.3(BICD2): c.320C>T (p.Ser107Leu) | CCTGATCCAGGAGTYGGCCTCCA | Spinal muscular atrophy, lower extremity predominant 2, autosomal dominant |
| 587783343 | BIN1 | NM_139343.2(BIN1): c.1713G>A (p.Trp571Ter) | CTGRAACCAGCACAAGGAGCTGG | Autosomal recessive centronuclear myopathy |
| 55758736 | BLK | NM_001715.2(BLK): c.211G>A (p.Ala71Thr) | CTACACCRCTATGAATGATCGGG, ACTACACCRCTATGAATGATCGG | Maturity-onset diabetes of the young, type 11, not specified |
| 367543025 | BLM | NM_000057.3(BLM): c.3197G>A (p.Cys1066Tyr) | TGATAATTRCTGTAAAACAAAGG | Bloom syndrome |
| 104894763 | BMP15 | NM_005448.2(BMP15): c.202C>T (p.Arg68Trp) | CCTAGGGCATTCACTGYGGTACA | Premature ovarian failure 4 |
| 137853320 | BMP15 | NM_005448.2(BMP15): c.631C>T (p.Gln211Ter) | CCGTTTTATGTGTCAGYAGCAAA | Premature ovarian failure 4 |
| 121912766 | BMP4 | NM_001202.3(BMP4): c.1037C>T (p.Ala346Val) | CCCCTTTCCACTGGYTGACCACC | Orofacial cleft 11 |
| 199476088 | BMPR1A | NM_004329.2(BMPR1A): c.1127G>A (p.Cys376Tyr) | AGTTRCTGCATTGCTGACCTGGG, GAGTTRCTGCATTGCTGACCTGG | Juvenile polyposis syndrome |
| 764466442 | BMPR1A | NM_004329.2(BMPR1A): c.1081C>T (p.Arg361Ter) | CCCGCAATTGCTCATYGAGACCT, CCGCAATTGCTCATYGAGACCTA | Hereditary cancer-predisposing syndrome |
| 137852744 | BMPR2 | NM_001204.6(BMPR2): c.1040G>A (p.Cys347Tyr) | ACCTRTGTTATTAGTGACTTTGG | Primary pulmonary hypertension |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852746 | BMPR2 | NM_001204.6(BMPR2): c.1471C>T (p.Arg491Trp) | CCAGGATGCAGAGGCTYGGCTTA | Primary pulmonary hypertension |
| 137852751 | BMPR2 | NM_001204.6(BMPR2): c.994C>T (p.Arg332Ter) | CCTGCAATTTCCCATYGAGATTT | Primary pulmonary hypertension |
| 137852756 | BMPR2 | NM_001204.6(BMPR2): c.1297C>T (p.Gln433Ter) | CCGTACCAGAGTACYAGATGGCT | Pulmonary hypertension, primary, 1, with hereditary hemorrhagic telangiectasia |
| 121964925 | BPGM | NM_199186.2(BPGM): c.268C>T (p.Arg90Cys) | CCTGGCGTCTAAATGAGYGTCAC | Deficiency of bisphosphoglycerate mutase |
| 397516894 | BRAF | NM_004333.4(BRAF): c.1720C>T (p.His574Tyr) | CCAAGTCAATCATCYACAGAGAC | Cardiofaciocutaneous syndrome |
| 397509284 | BRCA1 | NM_007294.3(BRCA1): c.5445G>A (p.Trp1815Ter) | GATGCCTGRACAGAGGACAATGG | Familial cancer of breast, Breast-ovarian cancer, familial 1, Hereditary cancer-predisposing syndrome |
| 80356937 | BRCA1 | NM_007294.3(BRCA1): c.5212G>A (p.Gly1738Arg) | GTCAGARGAGATGTGGTCAATGG | Familial cancer of breast, Breast-ovarian cancer, familial 1 |
| 80356962 | BRCA1 | NM_007294.3(BRCA1): c.5444G>A (p.Trp1815Ter) | GATGCCTRGACAGAGGACAATGG | Familial cancer of breast, Hereditary breast and ovarian cancer syndrome, Breast-ovarian cancer, familial 1, Hereditary cancer-predisposing syndrome |
| 80357219 | BRCA1 | NM_007294.3(BRCA1): c.5345G>A (p.Trp1782Ter) | GAATRGATGGTACAGCTGTGTGG | Familial cancer of breast, Breast-ovarian cancer, familial 1 |
| 80357284 | BRCA1 | NM_007294.3(BRCA1): c.5346G>A (p.Trp1782Ter) | GAATGRATGGTACAGCTGTGTGG | Familial cancer of breast, Breast-ovarian cancer, familial 1, Hereditary cancer-predisposing syndrome |
| 80357292 | BRCA1 | NM_007294.3(BRCA1): c.962G>A (p.Trp321Ter) | TAACAGATRGGCTGGAAGTAAGG | Familial cancer of breast, Hereditary breast and ovarian cancer syndrome, Breast-ovarian cancer, familial 1, Hereditary cancer-predisposing syndrome |
| 80358008 | BRCA1 | NM_007294.3(BRCA1): c.4676-1G>A | TTCARAGGGAACCCCTTACCTGG | Breast-ovarian cancer, familial 1 |
| 80358070 | BRCA1 | NM_007294.3(BRCA1): c.4097-1G>A | TTTAARGTGAAGCAGCATCTGGG, ATTTAARGTGAAGCAGCATCTGG | Familial cancer of breast, Breast-ovarian cancer, familial 1 |
| 62625307 | BRCA1 | NM_007294.3(BRCA1): c.3598C>T (p.Gln1200Ter) | CCCATACACATTTGGCTYAGGGT, CCATACACATTTGGCTYAGGGTT | Familial cancer of breast, Hereditary breast and ovarian cancer syndrome, Breast-ovarian cancer, familial 1, Hereditary cancer-predisposing syndrome |
| 80356952 | BRCA1 | NM_007294.3(BRCA1): c.1630C>T (p.Gln544Ter) | CCAAACGGAGCAGAATGGTYAAG | Familial cancer of breast, Breast-ovarian cancer, familial 1 |
| 80357089 | BRCA1 | NM_007294.3(BRCA1): c.3331C>T (p.Gln1111Ter) | CCTGAAATAAAAAGYAAGAATA | Familial cancer of breast, Breast-ovarian cancer, familial 1 |
| 80357123 | BRCA1 | NM_007294.3(BRCA1): c.5251C>T (p.Arg1751Ter) | CCACCAAGGTCCAAAGYGAGCA | Familial cancer of breast, Hereditary breast and ovarian cancer syndrome, Breast-ovarian cancer, familial 1, Hereditary cancer-predisposing syndrome |
| 80357211 | BRCA1 | NM_007294.3(BRCA1): c.949C>T (p.Gln317Ter) | CCTGGCTTAGCAAGGAGCYAACA | Familial cancer of breast, Breast-ovarian cancer, familial 1 |
| 80357372 | BRCA1 | NM_007294.3(BRCA1): c.415C>T (p.Gln139Ter) | CCGTGCCAAAAGACTTCTAYAGA, CCAAAAGACTTCTAYAGAGTGAA | Familial cancer of breast, Breast-ovarian cancer, familial 1 |
| 80357471 | BRCA1 | NM_007294.3(BRCA1): c.178C>T (p.Gln60Ter) | CCAGAAGAAAGGGCCTTCAYAGT | Familial cancer of breast, Breast-ovarian cancer, familial 1 |
| 587781506 | BRCA2 | NM_000059.3(BRCA2): c.7877G>A (p.Trp2626Ter) | TAGATRGATCATATGGAAACTGG | Hereditary breast and ovarian cancer syndrome, Hereditary cancer-predisposing syndrome |
| 80358543 | BRCA2 | NM_000059.3(BRCA2): c.2978G>A (p.Trp993Ter) | AACAAATRGGCAGGACTCTTAGG | Breast-ovarian cancer, familial 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80358544 | BRCA2 | NM_000059.3(BRCA2): c.2979G>A (p.Trp993Ter) | AACAAATGRGCAGGACTCTTAGG | Familial cancer of breast, Breast-ovarian cancer, familial 2, Hereditary cancer-predisposing syndrome |
| 80359015 | BRCA2 | NM_000059.3(BRCA2): c.7886G>A (p.Trp2629Ter) | CATATRGAAACTGGCAGCTATGG | Familial cancer of breast, Breast-ovarian cancer, familial 2 |
| 80359205 | BRCA2 | NM_000059.3(BRCA2): c.99317G>A (p.Trp3106Ter) | GTTTTRGATAGACCTTAATGAGG | Familial cancer of breast, Breast-ovarian cancer, familial 2 |
| 80359803 | BRCA2 | NM_000059.3(BRCA2): c.8754G>A (p.Glu2918=) | CCTTGARGTGAGAGAGTAAGAGG | Familial cancer of breast, Breast-ovarian cancer, familial 2, Hereditary cancer-predisposing syndrome |
| 730881581 | BRCA2 | NM_000059.3(BRCA2): c.8174G>A (p.Trp2725Ter) | AGATGGGTRGTATGCTGTTAAGG | Familial cancer of breast |
| 276174913 | BRCA2 | NM_000059.3(BRCA2): c.8869C>T (p.Gln2957Ter) | CCATGGAATCTGCTGAAYAAAAG | Familial cancer of breast, Breast-ovarian cancer, familial 2 |
| 80358515 | BRCA2 | NM_000059.3(BRCA2): c.250C>T (p.Gln84Ter) | CCAATAATATTCAAAGAGYAAGG | Familial cancer of breast, Hereditary breast and ovarian cancer syndrome, Breast-ovarian cancer, familial 2 |
| 80358578 | BRCA2 | NM_000059.3(BRCA2): c.3319C>T (p.Gln1107Ter) | CCATAATTTAACACCTAGCYAAA | Familial cancer of breast, Breast-ovarian cancer, familial 2, Hereditary cancer-predisposing syndrome |
| 80358851 | BRCA2 | NM_000059.3(BRCA2): c.6124C>T (p.Gln2042Ter) | CCAGAACATTTAATATCCYAAAA | Hereditary breast and ovarian cancer syndrome, Breast-ovarian cancer, familial 2 |
| 80358920 | BRCA2 | NM_000059.3(BRCA2): c.6952C>T (p.Arg2318Ter) | CCTAGGCACAATAAAGATYGAA | Familial cancer of breast, Breast-ovarian cancer, familial 2 |
| 587782010 | BRCA2 | NM_000059.3(BRCA2): c.8608C>T (p.Gln2870Ter) | CCTTATTCACTAAAATTYAGGAG | Hereditary cancer-predisposing syndrome |
| 587782613 | BRCA2 | NM_000059.3(BRCA2): c.3412C>T (p.Gln1138Ter) | CCAAGCTACATATTGYAGAAGAG | Hereditary cancer-predisposing syndrome |
| 397507395 | BRCA2 | NM_000059.3(BRCA2): c.7963C>T (p.Gln2655Ter) | CCCAGAAAGGGTGCTTCTTYAAC, CCAGAAAGGGTGCTTCTTYAACT | Familial cancer of breast, Breast-ovarian cancer, familial 2 |
| 397507617 | BRCA2 | NM_000059.3(BRCA2): c.196C>T (p.Gln66Ter) | CCTATTTAAAACTCCAYAAAGGA | Familial cancer of breast, Breast-ovarian cancer, familial 2, Hereditary cancer-predisposing syndrome |
| 587782539 | BRIP1 | NM_032043.2(BRIP1): c.2576-1G>A | TTCTTTARGACTTTCTAAATGGG, TTTCTTTARGACTTTCTAAATGG | Hereditary cancer-predisposing syndrome |
| 137852985 | BRIP1 | NM_032043.2(BRIP1): c.897G>A (p.Met299Ile) | AGTGCATRGAATTGCTAGATGGG, AAGTGCATRGAATTGCTAGATGG | Breast cancer, early-onset |
| 587782574 | BRIP1 | NM_032043.2(BRIP1): c.2377C>T (p.Gln793Ter) | CCAAATGTGAAAGATCTAYAGGT | Hereditary cancer-predisposing syndrome |
| 730881633 | BRIP1 | NM_032043.2(BRIP1): c.1066C>T (p.Arg356Ter) | CCATATTACACAGCCYGAGAACT | Hereditary cancer-predisposing syndrome |
| 74315287 | BSND | NM_057176.2(BSND): c.28G>A (p.Gly10Ser) | GGATCRGCTTCATTGTGCTGGGG, CGGATCRGCTTCATTGTGCTGGG, CCGGATCRGCTTCATTGTGCTGG | Bartter syndrome type 4 |
| 74315289 | BSND | NM_057176.2(BSND): c.139G>A (p.Gly47Arg) | TGGTGATCRGGGGCATCATCTGG | Bartter syndrome type 4 |
| 146015592 | BTD | NM_000060.3(BTD): c.470G>A (p.Arg157His) | GCTCCAGCRCCTGAGTTGTATGG | Biotinidase deficiency, not provided |
| 397514396 | BTD | NM_000060.3(BTD): c.934G>A (p.Gly312Ser) | AAGTRGCATACACACCCCTCTGG | Biotinidase deficiency |
| 397514343 | BTD | NM_000060.3(BTD): c.236G>A (p.Arg79His) | CATCAGCCRCCAAGAGGCCTTGG | Biotinidase deficiency |
| 397514375 | BTD | NM_000060.3(BTD): c.595G>A (p.Val199Met) | AATGTCRTGTTCAGCAATAATGG | Biotinidase deficiency |
| 397514417 | BTD | NM_000060.3(BTD): c.1333G>A (p.Gly445Arg) | GATRGGCTTCACACAGTACATGG | Biotinidase deficiency |
| 397514428 | BTD | NM_000060.3(BTD): c.1610G>A (p.Gly537Glu) | CTATGRGCGCTTGTATGAGAGGG, TCTATGRGCGCTTGTATGAGAGG | Biotinidase deficiency |
| 397514429 | BTD | NM_000060.3(BTD): c.1613G>A (p.Arg538His) | CTATGGGCRCTTGTATGAGAGGG | Biotinidase deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 367902696 | BTD | NM_000060.3(BTD): c.443G>A (p.Arg148His) | TCACCRCTTCAATGACACAGAGG | Biotinidase deficiency |
| 34885143 | BTD | NM_000060.3(BTD): c.133G>A (p.Gly45Arg) | CCACACCRGGGAGGAGAGCGTGG | Biotinidase deficiency, not specified, not provided |
| 146600671 | BTD | NM_000060.3(BTD): c.1369G>A (p.Val457Met) | TCCAARTGTGTGCCCTGGTCAGG | Biotinidase deficiency |
| 377651057 | BTD | NM_000060.3(BTD): c.935G>A (p.Gly312Asp) | AAGTGRCATACACACCCCTCTGG | Biotinidase deficiency |
| 104893687 | BTD | NM_000060.3(BTD): c.235C>T (p.Arg79Cys) | CCCTCTGGCTCTCATCAGCYGCC, CCTCTGGCTCTCATCAGCYGCCA | Biotinidase deficiency, not provided |
| 104893688 | BTD | NM_000060.3(BTD): c.1595C>T (p.Thr532Met) | CCTCTGGGCTGGTGAYGGCGGCT | Biotinidase deficiency, not provided |
| 397514349 | BTD | NM_000060.3(BTD): c.283C>T (p.Gln95Ter) | CCTTGACATCTATGAAYAGCAAG | Biotinidase deficiency |
| 397514363 | BTD | NM_000060.3(BTD): c.469C>T (p.Arg157Cys) | CCTCTAGGTGCTCCAGYGCCTGA | Biotinidase deficiency |
| 397514364 | BTD | NM_000060.3(BTD): c.485C>T (p.Ala162Val) | CCTGAGTTGTATGGYCATCAGGG | Biotinidase deficiency |
| 372844636 | BTD | NM_000060.3(BTD): c.631C>T (p.Arg211Cys) | CCCTTGTTGACCGCTACYGTAAA, CCTTGTTGACCGCTACYGTAAAC | Biotinidase deficiency |
| 128621209 | BTK | NM_000061.2(BTK): c.1838G>A (p.Gly613Asp) | CCCAAGRCCTACGTCTCTACAGG | X-linked agammaglobulinemia |
| 128621194 | BTK | NM_000061.2(BTK): c.862C>T (p.Arg288Trp) | CCAAACACATGACTYGGAGTCAG | X-linked agammaglobulinemia |
| 128621204 | BTK | NM_000061.2(BTK): c.1684C>T (p.Arg562Trp) | CCAAATTTCCAGTCYGGTGGTCC | X-linked agammaglobulinemia |
| 128621193 | BTK | NM_000061.2(BTK): c.763C>T (p.Arg255Ter) | CCATGGTGGAGAGCAYGAGATAA | X-linked agammaglobulinemia |
| 137852956 | C10orf2 | NM_021830.4(C10orf2): c.908G>A (p.Arg303Gln) | GGCRGATTGTATTCTGGTTGGGG, CGGCRGATTGTATTCTGGTTGGG, CCGGCRGATTGTATTCTGGTTGG | Autosomal dominant progressive external ophthalmoplegia with mitochondrial DNA deletions 3 |
| 80356544 | C10orf2 | NM_021830.4(C10orf2): c.1370C>T (p.Thr457Ile) | CCCGGGTCATGCTGAYACAGTTT, CCGGGTCATGCTGAYACAGTTTG | Mitochondrial DNA-depletion syndrome 3, hepatocerebral, Mitochondrial DNA depletion syndrome 7 (hepatocerebral type) |
| 587777698 | C12orf57 | NM_138425.3(C12orf57): c.184C>T (p.Gln62Ter) | CCCGTGGCCACGCAGATCYAGCA, CCGTGGCCACGCAGATCYAGCAG | Temtamy syndrome |
| 397514539 | C12orf65 | NM_152269.4(C12orf65): c.394C>T (p.Arg132Ter) | CCTGTTCACAAAGAAAAAYGAGA | Spastic paraplegia 55, autosomal recessive |
| 397514477 | C19orf12 | NM_001031726.3 (C19orf12):c.32C>T (p.Thr11Met) | CCCTCGAAGGCCCGCCAYGATGA, CCTCGAAGGCCCGCCAYGATGAC | Neurodegeneration with brain iron accumulation 4 |
| 587777653 | C2CD3 | NM_001286577.1(C2CD3): c.184C>T (p.Arg62Ter) | ACTCRGACAAGTACACAAGTGGG, CACTCRGACAAGTACACAAGTGG | Joubert syndrome, Orofaciodigital syndrome xiv |
| 121909587 | C5 | NM_001735.2(C5): c.55C>T(p.Gln19Ter) | CCTGGGGAAAACCTGGGGAYAGG | Leiner disease |
| 139675596 | C5orf42 | NM_023073.3(C5orf42): c.7477C>T (p.Arg2493Ter) | TCTGGTCRAAAAGTCACATTTGG | Joubert syndrome 17 |
| 121434552 | CA4 | NM_000717.3(CA4): c.206G>A (p.Arg69His) | CTGGGACRCTTCTTCTTCTCTGG | Retinitis pigmentosa 17 |
| 104894559 | CA4 | NM_000717.3(CA4): c.40C>T (p.Arg14Trp) | CCTGGCCCTCTCCGCGGCGYGGC, CCCTCTCCGCGGCGYGGCCATCG | Retinitis pigmentosa 17 |
| 147623570 | CA5A | NM_001739.1(CA5A): c.555G>A (p.Lys185=) | CCCGAGCAAGTGATTACYTTTAA, CCGAGCAAGTGATTACYTTTAAA | Carbonic anhydrase VA deficiency, hyperammonemia due to |
| 121908215 | CACNA1A | NM_001127221.1(CACNA1A): c.877G>A (p.Gly293Arg) | ACTGGGAARGGCCCAACAACGGG | Spinocerebellar ataxia 6, Episodic ataxia type 2 |
| 121908216 | CACNA1A | NM_001127221.1(CACNA1A): c.4982G>A (p.Arg1661His) | TCCRCCTCTTCCGAGCTGCCCGG | Episodic ataxia type 2 |
| 121908236 | CACNA1A | NM_001127221.1(CACNA1A): c.860G>A (p.Cys287Tyr) | AATRTCAGCCCTACTGGGAAGGG, AAATRTCAGCCCTACTGGGAAGG, GACCAAATRTCAGCCCTACTGGG | Episodic ataxia type 2 |
| 121908212 | CACNA1A | NM_001127221.1(CACNA1A): c.1997C>T (p.Thr666Met) | CCCCTTTCAGATCCTGAYGGGCG, CCCTTTCAGATCCTGAYGGGCGA, CCTTTCAGATCCTGAYGGGCGAA | Familial hemiplegic migraine type 1 |
| 121909323 | CACNA1A | NM_001127221.1(CACNA1A): c.3832C>T (p.Arg1278Ter) | CCCTTACAGGTGCTGYGATACTT, CCTTACAGGTGCTGYGATACTTT | Episodic ataxia type 2 |
| 121909324 | CACNA1A | NM_001127221.1(CACNA1A): c.4636C>T (p.Arg1546Ter) | CCAAGCCGCTGACCYGACACATG | Episodic ataxia type 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776693 | CACNA1A | NM_001127221.1(CACNA1A): c.3992+1G>A | CCCTTGCGAGGAGACTTAYGTGA, CCTTGCGAGGAGACTTAYGTGAA | Episodic ataxia type 2 |
| 80315385 | CACNA1C | NM_000719.6(CACNA1C): c.1204G>A (p.Gly402Ser) | TGGTTCTCRGTGTGCTTAGCGGG | Timothy syndrome, Congenital long QT syndrome |
| 79891110 | CACNA1C | NM_000719.6(CACNA1C): c.1216G>A (p.Gly406Arg) | TTAGCRGGTAAGCAGGACCAAGG | Timothy syndrome, Long QT syndrome, Congenital long QT syndrome, not provided |
| 587782933 | CACNA1C | NM_001167623.1(CACNA1C): c.1204G>A (p.Gly402Ser) | TGGTTCTCRGTGTGTTGAGCGGG | Paroxysmal familial ventricular fibrillation, not provided |
| 122456133 | CACNA1F | NM_005183.3(CACNA1F): c.1106G>A (p.Gly369Asp) | TTGRCGTCCTGAGTGGGTGAGGG, CTTGRCGTCCTGAGTGGGTGAGG | Congenital stationary night blindness, type 2A |
| 122456135 | CACNA1F | NM_005183.3(CACNA1F): c.2683C>T (p.Arg895Ter) | CCGCTGAGGACCCCATCYGAGCC | Congenital stationary night blindness, type 2A |
| 80338777 | CACNA1S | NM_000069.2(CACNA1S): c.1583G>A (p.Arg528His) | TCCRCTGCATCCGCCTCCTGAGG | Hypokalemic periodic paralysis 1 |
| 587777742 | CACNB2 | NM_201590.2(CACNB2): c.32C>T (p.Thr11Ile) | CCTTATAGCTCCTCAAAYTAAAT | Brugada syndrome 4 |
| 121917812 | CACNB2 | NM_201590.2(CACNB2): c.1442C>T (p.Ser481Leu) | CCGCTCTTCCTCCTYAGCCCCAC | Brugada syndrome 4 |
| 267606699 | CANT1 | NM_001159772.1(CANT1): c.899G>A (p.Arg300His) | CCTGCCGCRCCGCGCCAGCCAGG | Desbuquois syndrome |
| 587776951 | CANT1 | NM_001159772.1(CANT1): c.-286+1G>A | CCGCGGGCGCAGTCACTCAYCCG | Desbuquois syndrome |
| 377546036 | CANT1 | NM_001159772.1(CANT1): c.676G>A (p.Val226Met) | CCTTGCCCAGGCCGCCCAYGTAC | Desbuquois syndrome |
| 141656719 | CAPN3 | NM_000070.2(CAPN3): c.1468C>T (p.Arg490Trp) | CCTGATGCAGAAGAACCGGYGGA | Limb-girdle muscular dystrophy, type 2A, not provided |
| 121434546 | CAPN3 | NM_000070.2(CAPN3): c.257C>T (p.Ser86Phe) | CCCACCGGATGAGACCYTCTCT, CCACCGGATGAGACCYTCTCTT | Limb-girdle muscular dystrophy, type 2A |
| 587777763 | CARD14 | NM_024110.4(CARD14): c.349+5G>A | GGTGARAGCTCCGACTTTGACGG | Psoriasis susceptibility 2 |
| 398122362 | CARD9 | NM_052813.4(CARD9): c.214G>A (p.Gly72Ser) | GACCRGCCACAAGGGCTACGTGG | Candidiasis, familial, 2 |
| 557671802 | CARS2 | NM_024537.3(CARS2): c.752C>T (p.Pro251Leu) | CCCRGCCTCCCGGGTCCCCAGGG, GCCCRGCCTCCCGGGTCCCCAGG | Alpers encephalopathy |
| 794727270 | CASK | NM_003688.3(CASK): c.79C>T (p.Arg27Ter) | CCCTTCAGTGTTGTAYGACGATG, CCTTCAGTGTTGTAYGACGATGT | FG syndrome 4, Mental retardation and microcephaly with pontine and cerebellar hypoplasia |
| 587783361 | CASK | NM_003688.3(CASK): c.2074C>T (p.Gln692Ter) | CCATGGAGAAGACCAAAYAGGAG | Mental retardation and microcephaly with pontine and cerebellar hypoplasia |
| 587783364 | CASK | NM_003688.3(CASK): c.2470C>T (p.Gln824Ter) | CCGGAAGATCCACGAGYAGGGGC | Mental retardation and microcephaly with pontine and cerebellar hypoplasia |
| 587783371 | CASK | NM_003688.3(CASK): c.880C>T (p.Gln294Ter) | CCAGAAACAGTAGAGYAGCTGAG | Mental retardation and microcephaly with pontine and cerebellar hypoplasia |
| 28936699 | CASP10 | NM_032977.3(CASP10): c.1241C>T (p.Ala414Val) | CCTTCCGTATCCATCGAAGYAGA, CCGTATCCATCGAAGYAGATGCT | Malignant lymphoma, non-Hodgkin |
| 104893700 | CASR | NM_000388.3(CASR): c.2009G>A (p.Gly670Glu) | TCATCGRGGAGCCCCAGGACTGG | Hyperparathyroidism, neonatal severe |
| 104893712 | CASR | NM_000388.3(CASR): c.1810G>A (p.Glu604Lys) | GATCRAGTTTCTGTCGTGGACGG, AGGAGATCRAGTTTCTGTCGTGG | Hypocalcemia, autosomal dominant 1 |
| 104893719 | CASR | NM_000388.3(CASR): c.1657G>A (p.Gly553Arg) | CAGGAAARGGATCATTGAGGGGG, CCAGGAAARGGATCATTGAGGGG | Hypocalciuric hypercalcemia, familial, type 1 |
| 121909264 | CASR | NM_000388.3(CASR): c.428G>A (p.Gly143Glu) | GTGGTGGRAGCAACTGGCTCAGG | Hypocalciuric hypercalcemia, familial, type 1 |
| 121909266 | CASR | NM_000388.3(CASR): c.196C>T (p.Arg66Cys) | CAGGTATAATTTCYGTGGGTTT | Hypocalciuric hypercalcemia, familial, type 1 |
| 267606708 | CBL | NM_005188.3(CBL): c.1259G>A (p.Arg420Gln) | TTCTGCCRATGTGAAATTAAAGG | Noonan syndrome-like disorder with or without juvenile myelomonocytic leukemia |
| 28934891 | CBS | NM_000071.2(CBS): c.1330G>A (p.Asp444Asn) | CTTCRACCAGGCGCCCGTGGTGG, GGGCTTCRACCAGGCGCCCGTGG | Homocystinuria due to CBS deficiency, Homocystinuria, pyridoxine-responsive, not provided |
| 121908255 | CBX2 | NM_005189.2(CBX2): c.293C>T (p.Pro98Leu) | CCTTTATCTTTCCAGGAACYCGA | 46,XY sex reversal, type 5 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 377177061 | CC2D2A | NM_001080522.2(CC2D2A): c.394C>T (p.Arg132Ter) | CCTCGGCCCAGACGCTTAYGAAG | Meckel-Gruber syndrome |
| 201133219 | CCDC114 | NM_144577.3(CCDC114): c.1391+5G>A | CCCTCCTGCCCTGCGCYTCACAG, CCTCCTGCCCTGCGCYTCACAGA | Ciliary dyskinesia, primary, 20 |
| 374909386 | CCDC40 | NM_017950.3(CCDC40): c.3354C>A (p.Tyr1118Ter) | CCGCGTGCGGGACGAGTAHCCCC | Ciliary dyskinesia, primary, 15 |
| 387907092 | CCDC40 | NM_017950.3(CCDC40): c.1951C>T (p.Gln651Ter) | CCACCAAATACTTCAACYAGCTC, CCAAATACTTCAACYAGCTCATC | Ciliary dyskinesia, primary, 15 |
| 587782989 | CCDC88C | NM_001080414.3(CCDC88C): c.1391G>A (p.Arg464His) | GTCCAGCCRCATCCTGAAGCTGG | Spinocerebellar ataxia 40 |
| 387907320 | CCDC88C | NM_001080414.3(CCDC88C): c.5058+1G>A | CCATRTGAGTGATCCGGACACGG | Hydrocephalus |
| 137852841 | CCM2 | NM_001029835.2(CCM2): c.382C>T (p.Gln128Ter) | CCGGGACACTTGACTYAGGAGCA | Cerebral cavernous malformations 2 |
| 587777929 | CCT7 | NM_001166284.1(CCT7): c.1313C>T (p.Ser438Leu) | CCATCAAGAACCCCGCTYGACT | Myocardial infarction 1 |
| 74315290 | CD247 | NM_198053.2(CD247): c.208C>T (p.Gln70Ter) | CCAGCAGGGCCAGAACYAGCTCT | Immunodeficiency due to defect in cd3-zeta |
| 730880296 | CD3D | NM_000732.4(CD3D): c.274+5G>A | TACRTGCTTCCTGAACCCTTTGG | Immunodeficiency 19 |
| 193922136 | CD40LG | NM_000074.2(CD40LG): c.761C>T (p.Thr254Met) | CCATGGCACTGGCTTCAYGTCCT | Immunodeficiency with hyper IgM type 1 |
| 587776775 | CD81 | NM_004356.3(CD81): c.561+1G>A | CAAGRTGCGCGAGGCCGGTGGGG, TCAAGRTGCGCGAGGCCGGTGGG, TTCAAGRTGCGCGAGGCCGGTGG | |
| 121918660 | CD8A | NM_001768.6(CD8A): c.331G>A (p.Gly111Ser) | CGAGRGCTACTATTTCTGCTCGG | Cd8 deficiency, familial |
| 113313967 | CDAN1 | NM_138477.2(CDAN1): c.1860+5G>A | CCCTTGTTCTGTTTTYGGACCTG, CCTTGTTCTGTTTTYGGACCTGC | Congenital dyserythropoietic anemia, type I |
| 120074167 | CDAN1 | NM_138477.2(CDAN1): c.2015C>T (p.P672L) | CCCTCCCAGGTCCCTCYGGTCCT, CCTCCCAGGTCCCTCYGGTCCTG | Congenital dyserythropoietic anemia, type I |
| 80338696 | CDAN1 | NM_138477.2(CDAN1): c.2140C>T (p.Arg714Trp) | CCCTTGCTGGAATATTACYGGGA, CCTTGCTGGAATATTACYGGGAC | Congenital dyserythropoietic anemia, type I |
| 80338697 | CDAN1 | NM_138477.2(CDAN1): c.3124C>T (p.Arg1042Trp) | CCTTGGCCGTGGGGCCAYGGGAC | Congenital dyserythropoietic anemia, type I |
| 121434263 | CDC73 | NM_024529.4(CDC73): c128G>A (p.Trp43Ter) | GTTTRGGGGTAAGTCCGGCATGG | Parathyroid carcinoma |
| 587776558 | CDC73 | NM_024529.4(CDC73): c.131+1G>A | GTTTGGGGRTAAGTCCGGCATGG | Hyperparathyroidism 1 |
| 587776559 | CDC73 | NM_024529.4(CDC73): c.238-1G>A | TTARACTGAAAATATTCCTGTGG | Hyperparathyroidism 2 |
| 786203576 | CDH1 | NM_004360.3(CDH1): c.60G>A (p.Trp20Ter) | CTCTTGRCTCTGCCAGGAGCCGG | Hereditary cancer-predisposing syndrome |
| 121964875 | CDH1 | NM_004360.3(CDH1): c.59G>A (p.Trp20Ter) | CTCTTRGCTCTGCCAGGAGCCGG | Hereditary diffuse gastric cancer |
| 121964877 | CDH1 | NM_004360.3(CDH1): c.1792C>T (p.Arg598Ter) | CCCCCATACCAGAACCTYGAACT, CCCCATACCAGAACCTYGAACTA, CCCATACCAGAACCTYGAACTAT, CCATACCAGAACCTYGAACTATA | Hereditary diffuse gastric cancer |
| 587782750 | CDH1 | NM_004360.3(CDH1): c.1921C>T (p.Gln641Ter) | CCAACTGGACCATTYAGTACAAC | Hereditary cancer-predisposing syndrome |
| 121434539 | CDH15 | NM_004933.2(CDH15): c.178C>T (p.Arg60Cys) | CCGAGAACCACAAGYGTCTCCCC | Mental retardation, autosomal dominant 3 |
| 397517353 | CDH23 | NM_022124.5(CDH23): c.7776G>A (p.Trp2592Ter) | CTGRGGCACCACCATGCTCCTGG | Usher syndrome, type 1D |
| 367928692 | CDH23 | NM_022124.5(CDH23): c.6050-9G>A | GCGGCACCRGGTGCCAGGTGTGG | Usher syndrome, type 1D |
| 727502931 | CDH23 | NM_022124.5(CDH23): c.7362+5G>A | GTGARCAGTGATGGAGGGCCTGG | Usher syndrome, type 1D |
| 121908354 | CDH23 | NM_022124.5(CDH23): c.719C>T (p.Pro240Leu) | CCCATCTTCATCAACCTGCYTTA, CCATCTTCATCAACCTGCYTTAC | Deafness, autosomal recessive 12 |
| 727503845 | CDK16 | NM_033018.3(CDK16): c.1258C>T (p.Arg420Ter) | CCTTTTGAGCCACGCACCCYGGT | not provided |
| 587783392 | CDK5RAP2 | NM_018249.5(CDK5RAP2): c.5227C>T (p.Gln1743Ter) | CCTGCTCAAACAGATCAGCYAGG | Primary autosomal recessive microcephaly 3 |
| 587783086 | CDKL5 | NM_003159.2(CDKL5): c.577G>A (p.Asp193Asn) | TCCGTGRACATGTGGTCGGTGGG, GTCCGTGRACATGTGGTCGGTGG | not provided |
| 267608653 | CDKL5 | NM_003159.2(CDKL5): c.2152G>A (p.Val718Met) | TACAGARGTAAGCCCACCCCCGG | Early infantile epileptic encephalopathy 2, not provided |
| 122460158 | CDKL5 | NM_003159.2(CDKL5): c.2500C>T (p.Gln834Ter) | CCTTTCTTTCAGAGCYAGCCATT | Early infantile epileptic encephalopathy 2, Atypical Rett syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61749704 | CDKL5 | NM_003159.2(CDKL5): c.539C>T (p.Pro180Leu) | CCAGATGGTATCGGTCCCYAGAA | Early infantile epileptic encephalopathy 2 |
| 267606713 | CDKL5 | NM_003159.2(CDKL5): c.863C>T (p.Thr288Ile) | CCAGCTGACAGATACTTGAYAGA | Early infantile epileptic encephalopathy 2 |
| 587783089 | CDKL5 | NM_003159.2(CDKL5): c.700C>T (p.Gln234Ter) | CCACTTCCATCTGAGYAGATGAA | not provided |
| 587783158 | CDKL5 | NM_003159.2(CDKL5): c.2596C>T (p.Gln866Ter) | CCAGCCCTTAACAGCTCAAYAAA, CCCTTAACAGCTCAAYAAACCAA, CCTTAACAGCTCAAYAAACCAAA | Early infantile epileptic encephalopathy 2, not provided |
| 267608643 | CDKL5 | NM_003159.2(CDKL5): c.1648C>T (p.Arg550Ter) | CCCTTCTGGAAGAAATAACYGAA, CCTTCTGGAAGAAATAACYGAAA | Early infantile epileptic encephalopathy 2, Atypical Rett syndrome, not provided |
| 267608659 | CDKL5 | NM_003159.2(CDKL5): c.2413C>T (p.Gln805Ter) | CCCTGATCTTCTGACGTTGYAGA, CCTGATCTTCTGACGTTGYAGAA | Early infantile epileptic encephalopathy 2 |
| 267608663 | CDKL5 | NM_003159.2(CDKL5): c.2593C>T (p.Gln865Ter) | CCAGCCCTTAACAGCTYAACAAA | Early infantile epileptic encephalopathy 2 |
| 121917832 | CDKN1B | NM_004064.4(CDKN1B): c.227G>A (p.Trp76Ter) | GAGTRGCAAGAGGTGGAGAAGGG, CGAGTRGCAAGAGGTGGAGAAGG | Multiple endocrine neoplasia, type 4 |
| 387907225 | CDKN1C | NM_000076.2(CDKN1C): c.820G>A (p.Asp274Asn) | GATCTCCRGTGAGCCCCGCACGG | Intrauterine growth retardation, metaphyseal dysplasia, adrenal hypoplasia congenita, and genital anomalies |
| 387906918 | CDT1 | NM_030928.3(CDT1): c.196G>A (p.Ala66Thr) | CACCGRCCCGCAGGAGACTGCGG | Meier-Gorlin syndrome 4 |
| 145646425 | CEP164 | NM_014956.4(CEP164): c.1726C>T (p.Arg576Ter) | CCCCACCCATGGTAGGYGATCCA, CCACCCATGGTAGGYGATCCACA | Nephronophthisis 15 |
| 387907310 | CEP164 | NM_014956.4(CEP164): c.277C>T (p.Arg93Trp) | CCATGTGACGAACACTATYGGAG | Nephronophthisis 15 |
| 387907311 | CEP164 | NM_014956.4(CEP164): c.1573C>T (p.Gln525Ter) | CCTGCAGCTGTCCCTCYAGAGGT | Nephronophthisis 15 |
| 371812716 | CEP41 | NM_018718.2(CEP41): c.1078C>T (p.Arg360Cys) | GGAGCRGGGGTTTGAGTGGCTGG | Joubert syndrome 9/15, digenic |
| 375801610 | CFAP53 | NM_145020.4(CFAP53): c.121C>T (p.Arg41Ter) | TGCGTCRGATTCTTTCTAGATGG | Heterotaxy, visceral, 6, autosomal |
| 398123065 | CFB | NM_001710.5(CFB): c.766C>T (p.Gln256Ter) | CCTGGCACCCAGGGGAAYAACAG | Complement factor B deficiency |
| 104893611 | CFC1 | NM_032545.3(CFC1): c.334C>T (p.Arg112Cys) | CCCGGCCCACTTCACCGGCYGCT, CCGGCCCACTTCACCGGCYGCTA, CCCACTTCACCGGCYGCTACTGC | Heterotaxy, visceral, 2, autosomal |
| 121913053 | CFH | NM_000186.3(CFH): c.2876G>A (p.Cys959Tyr) | TACAAATRTTTTGAAGGTTTTGG | Factor H deficiency |
| 121964916 | CFI | NM_000204.3(CFI): c.728G>A (p.Gly243Asp) | TGTGATGRTATCAATGATTGTGG | Afibrinogenemia |
| 132630258 | CFP | NM_002621.2(CFP): c.481C>T (p.Arg161Ter) | CCCGGACCCGCAGGYGAGCCTGT | Properdin deficiency, X-linked |
| 672601317 | CFTR | NM_000492.3(CFTR): c.830G>A (p.Trp277Ter) | ATACTGCTRGGAAGAAGCAATGG | Cystic fibrosis |
| 121908753 | CFTR | NM_000492.3(CFTR): c.1055G>A (p.Arg352Gln) | GGTCACTCRGCAATTTCCCTGGG | Cystic fibrosis |
| 121909010 | CFTR | NM_000492.3(CFTR): c.3947G>A (p.Trp1316Ter) | AATATRGAAAGTTGCAGATGAGG | Cystic fibrosis |
| 397508200 | CFTR | NM_000492.3(CFTR): c.1393-1G>A | TTTCCARACTTCACTTCTAATGG | Cystic fibrosis |
| 387906369 | CFTR | NM_000492.3(CFTR): c.3718-1G>A | ACCTTATARGTGGGCCTCTTGGG | Cystic fibrosis |
| 397508256 | CFTR | NM_000492.3(CFTR): c.166G>A (p.Glu56Lys) | CAGARAATGGGATAGAGAGCTGG | Cystic fibrosis |
| 397508279 | CFTR | NM_000492.3(CFTR): c.170G>A (p.Trp57Ter) | CAGAGAATRGGATAGAGAGCTGG | Cystic fibrosis |
| 77409459 | CFTR | NM_000492.3(CFTR): c.1013C>T (p.Thr338Ile) | CCTCCGGAAAATATTCAYCACCA, CCGGAAAATATTCAYCACCATCT | Cystic fibrosis |
| 121908760 | CFTR | NM_000492.3(CFTR): c.2125C>T (p.Arg709Ter) | CCAATCAACTCTATAYGAAATT | Cystic fibrosis |
| 121908802 | CFTR | NM_000492.3(CFTR): c.595C>T (p.His199Tyr) | CCAGGGACTTGCATTGGCAYATT | Cystic fibrosis |
| 121908810 | CFTR | NM_000492.3(CFTR): c.2290C>T (p.Arg764Ter) | CCCCACGCTTCAGGCAYGAAGGA, CCACGCTTCAGGCAYGAAGGAGG | Cystic fibrosis |
| 374946172 | CFTR | NM_000492.3(CFTR): c.2353C>T (p.Arg785Ter) | CCAAGGTCAGAACATTCACYGAA | Cystic fibrosis |
| 121912816 | CHAT | NM_020549.4(CHAT): c.1321G>A (p.Glu441Lys) | TGCRAACACTCCCCATTCGATGG | Familial infantile myasthenia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912819 | CHAT | NM_020549.4(CHAT): c.1679G>A (p.Arg560His) | TCCATCCRCCGATTCCAGGAGGG, GTCCATCCRCCGATTCCAGGAGG | Familial infantile myasthenia |
| 794727516 | CHAT | NM_020549.4(CHAT): c.418C>T (p.Gln140Ter) | CCCGTGCCCCCGCTGYAGCAGAC, CCGTGCCCCCGCTGYAGCAGACC | Familial infantile myasthenia |
| 121912821 | CHAT | NM_020549.4(CHAT): c.1493C>T (p.Ser498Leu) | CCACTTAGCCTCCTYGGCAGAAA | Familial infantile myasthenia |
| 398123000 | CHD2 | NM_001271.3(CHD2): c.1396C>T (p.Arg466Ter) | CCCTGAAGCAGAGACCAYGATTT, CCTGAAGCAGAGACCAYGATTTG | Epileptic encephalopathy, childhood-onset |
| 727503863 | CHD7 | NM_017780.3(CHD7): c.2933G>A (p.Trp978Ter) | TAAACTRGCTACTTTTCAATTGG | CHARGE association |
| 121434343 | CHD7 | NM_017780.3(CHD7): c.6322G>A (p.Gly2108Arg) | TAAACACRGGGTCAGTCGGACGG | CHARGE association |
| 587783429 | CHD7 | NM_017780.3(CHD7): c.1480C>T (p.Arg494Ter) | CCCACAAGCAATCCAGGAAYGAC, CCACAAGCAATCCAGGAAYGACT | CHARGE association |
| 727503861 | CHD7 | NM_017780.3(CHD7): c.1369C>T (p.Gln457Ter) | CCCCAGAAACATGCAGYAGTCTC | not provided |
| 587783440 | CHD7 | NM_017780.3(CHD7): c.4318C>T (p.Gln1440Ter) | CCCAGAAACATGCAGYAGTCTCG, CCAGAAACATGCAGYAGTCTCGT | CHARGE association |
| 587783458 | CHD7 | NM_017780.3(CHD7): c.7957C>T (p.Arg2653Ter) | CCTGGATAAAGTCTGCTAYAGT CCTGTTGTCAATAAAYGAAATGG | CHARGE association |
| 786203889 | CHEK2 | NM_007194.3(CHEK2): c.278G>A (p.Trp93Ter) | TGCCCCCTRGGCTCGATTATGGG | Hereditary cancer-predisposing syndrome |
| 587781269 | CHEK2 | NM_007194.3(CHEK2): c.283C>T (p.Arg95Ter) | CCCCTGCCCCCTGGGCTYGATTA, CCCTGCCCCCTGGGCTYGATTAT, CCTGCCCCCTGGGCTYGATTATG | Hereditary cancer-predisposing syndrome |
| 17883862 | CHEK2 | NM_007194.3(CHEK2): c.254C>T (p.Pro85Leu) | CCTGAGGACCAAGAACYTGAGGA | Familial cancer of breast, Hereditary cancer-predisposing syndrome, Osteosarcoma, not specified |
| 63750355 | CHMP2B | NM_014043.3(CHMP2B): c.493C>T (p.Gln165Ter) | CCAGGATATTGTGAATYAAGTTC | Frontotemporal Dementia, Chromosome 3-Linked, not provided |
| 121912796 | CHN1 | NM_001822.5(CHN1): c.682G>A (p.Gly228Ser) | ATGTGGRGTCTCATTGCTCAGGG, TATGTGGRGTCTCATTGCTCAGG | Duane syndrome type 2 |
| 121912798 | CHN1 | NM_001822.5(CHN1): c.937G>A (p.Glu313Lys) | CCTAATTRAAGATGTCAAGATGG | Duane syndrome type 2 |
| 387906599 | CHN1 | NM_001822.5(CHN1): c.422C>T (p.Pro141Leu) | CCAAGATGACGATAAACCYAATT | Duane syndrome type 2 |
| 281865066 | CHRNA4 | NM_000744.6(CHRNA4): c.878C>T (p.Thr293Ile) | CCTGCTGCTCATCAYCGAGATCA | Epilepsy, nocturnal frontal lobe, type 1 |
| 137852810 | CHRNB1 | NM_000747.2(CHRNB1): c.865G>A (p.Val289Met) | TACTRTGTTCCTGCTGCTGCTGG | MYASTHENIC SYNDROME, CONGENITAL, 2A, SLOW-CHANNEL |
| 121912672 | CHRNG | NM_005199.4(CHRNG): c.136C>T (p.Arg46Ter) | CCTGCGGCCCGCGGAAYGAGACT | Multiple pterygium syndrome Escobar type |
| 267606725 | CHRNG | NM_005199.4(CHRNG): c.13C>T (p.Gln5Ter) | CCATGCATGGGGGCYAGGGGCCG | Multiple pterygium syndrome Escobar type |
| 267606734 | CHST3 | NM_004273.4(CHST3): c.1114G>A (p.Glu372Lys) | GCTACRAGGACGTGGCACGCGGG, CGCTACRAGGACGTGGCACGCGG | Spondyloepiphyseal dysplasia with congenital joint dislocations |
| 80356700 | CLCN1 | NM_000083.2(CLCN1): c.689G>A (p.Gly230Glu) | CGTGGRGAAAGAGGTAGGCCTGG | Myotonia congenita, Congenital myotonia, autosomal dominant form |
| 80356702 | CLCN1 | NM_000083.2(CLCN1): c.950G>A (p.Arg317Gln) | TGTTTCRAGTGCTGGCAGTGTGG | Myotonia congenita, Congenital myotonia, autosomal recessive form, Congenital myotonia, autosomal dominant form |
| 80356693 | CLCN1 | NM_000083.2(CLCN1): c.1412C>T (p.Ser471Phe) | CCAGTTCTGGATGTYCATCGTGG | Myotonia congenita |
| 80356706 | CLCN1 | NM_000083.2(CLCN1): c.2795C>T (p.Pro932Leu) | CCCCAGAGACCCTGTGCYATCT, CCCAGAGACCCTGTGCYATCTC, CCAGAGACCCTGTGCYATCTCC | Myotonia congenita, Congenital myotonia, autosomal recessive form |
| 80356694 | CLCN1 | NM_000083.2(CLCN1): c.1439C>T (p.Pro480Leu) | CCACCACTATGCCCATACYCTGC, CCACTATGCCCATACYCTGCGGA | Myotonia congenita, Congenital myotonia, autosomal dominant form |
| 201330912 | CLCN2 | NM_004366.5(CLCN2): c.1709G>A (p.Trp570Ter) | CCGTACTGGTGGCGGCCCYAGCC | Leukoencephalopathy with ataxia |
| 151340625 | CLCN5 | NM_001127899.3(CLCN5): c.1727G>A (p.Gly576Glu) | GTTGRGGCTGCAGCCTGCTTAGG | |
| 121434433 | CLCN7 | NM_001287.5(CLCN7): c.2285G>A (p.Arg762Gln) | TGTTCCRGGCCCTGGGCCTGCGG | Osteopetrosis autosomal recessive 4 |
| 121434432 | CLCN7 | NM_001287.5(CLCN7): c.1663C>T (p.Gln555Ter) | CCTGATGGGAGCTGCTGCCYAGC | Osteopetrosis autosomal recessive 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434435 | CLCN7 | NM_001287.5(CLCN7): c.2299C>T (p.Arg767Trp) | CCGGGCCCTGGGCCTGYGGCACC | Osteopetrosis autosomal dominant type 2, Osteopetrosis autosomal recessive 4 |
| 121909132 | CLCNKB | NM_000085.4(CLCNKB): c.610G>A (p.Ala204Thr) | GGCARCGGCGGCAGTGGGCGTGG | Bartter syndrome type 3 |
| 121909136 | CLCNKB | NM_000085.4(CLCNKB): c.1830G>A (p.Trp610Ter) | CTGRGCTCCTGGACACCAGGTGG, TTCCTGRGCTCCTGGACACCAGG | Bartter syndrome, type 3, with hypocalciuria |
| 121909131 | CLCNKB | NM_000085.4(CLCNKB): c.371C>T (p.Pro124Leu) | CCAAGGTTCTGGAATCCYGGAGG | Bartter syndrome type 3 |
| 104893721 | CLDN16 | NM_006580.3(CLDN16): c.715G>A (p.Gly239Arg) | CTCRGAATGGCTGGGTCTCTGGG, GCTCRGAATGGCTGGGTCTCTGG | Primary hypomagnesemia |
| 104893723 | CLDN16 | NM_006580.3(CLDN16): c.593G>A (p.Gly198Asp) | TCAGRTACCCCAGGAATCATTGG | Primary hypomagnesemia |
| 104893727 | CLDN16 | NM_006580.3(CLDN16): c.698G>A (p.Gly233Asp) | TTTGRTTGGTCCTGTTGGCTCGG | Primary hypomagnesemia |
| 796052335 | CLN3 | NM_001042432.1(CLN3): c.949C>T (p.Gln317Ter) | CCCTGAGTCACGCTYAGCAATAC | not provided |
| 104894484 | CLN6 | NM_017882.2(CLN6): c.368G>A (p.Gly123Asp) | CATGGRTGCCAGCATCCACCTGG | Ceroid lipofuscinosis neuronal 6 |
| 796052356 | CLN6 | NM_017882.2(CLN6): c.665+1G>A | CTGRTGAGTGGACATCAGCATGG | not provided |
| 154774635 | CLN6 | NM_017882.2(CLN6): c.139C>T (p.Leu47Phe) | CCCTTCCACCTCGACYTCTGGTT, CCTTCCACCTCGACYTCTGGTTC | Adult neuronal ceroid lipofuscinosis, not provided |
| 104893615 | CNGA3 | NM_001298.2(CNGA3): c.1669G>A (p.Gly557Arg) | ACATCAAGRGGAGCAAGTCGGGG | Achromatopsia 2, not specified |
| 104893619 | CNGA3 | NM_001298.2(CNGA3): c.1585G>A (p.Val529Met) | GGCCRTGGTGGCTGATGATGGGG, TGGCCRTGGTGGCTGATGATGGG, CTGGCCRTGGTGGCTGATGATGG | Achromatopsia 2 |
| 104893613 | CNGA3 | NM_001298.2(CNGA3): c.847C>T (p.Arg283Trp) | CCGCCTACTGAAGTTTTCCYGGC, CCTACTGAAGTTTTCCYGGCTCT | Achromatopsia 2 |
| 104893620 | CNGA3 | NM_001298.2(CNGA3): c.829C>T (p.Arg277Cys) | CCAGAAGTTGAGGTTCAACYGCC, CCAGAAGTGAGGTTCAACYGCCT | Achromatopsia 2 |
| 104893621 | CNGA3 | NM_001298.2(CNGA3): c.1306C>T (p.Arg436Trp) | CCAAGGACTTGGAGACGYGGGTT | Achromatopsia 2 |
| 372504780 | CNGB1 | NM_001297.4(CNGB1): c.952C>T (p.Gln318Ter) | TCCTRGTGGGCATCCTCCCAGGG, ATCCTRGTGGGCATCCTCCCAGG | Retinitis pigmentosa 45, not provided |
| 786205909 | CNNM2 | NM_017649.4(CNNM2): c.364G>A (p.Glu122Lys) | CCTTCACCRAGCACGAGCGGCGG | HYPOMAGNESEMIA, SEIZURES, AND MENTAL RETARDATION |
| 786205910 | CNNM2 | NM_017649.4(CNNM2): c.1069G>A (p.Glu357Lys) | CTTCGGARAGATCGTGCCCCAGG | HYPOMAGNESEMIA, SEIZURES, AND MENTAL RETARDATION |
| 80100937 | CNNM4 | NM_020184.3(CNNM4): c.1690C>T (p.Gln564Ter) | CCTCCTACAGAGGTCTCTYAGTT, CCTACAGAGGTCTCTYAGTTTAG | Cone-rod dystrophy amelogenesis imperfecta |
| 398124268 | CNTNAP2 | NM_014141.5(CNTNAP2): c.2153G>A (p.Trp718Ter) | TACTRGGGAGGCTCTGGGCCTGG | not provided |
| 587777136 | COASY | NM_025233.6(COASY): c.175C>T (p.Gln59Ter) | CCCCAGTCCAGCCCCGTGYAGGC, CCAGTCCAGCCCCGTGYAGGCC, CCAGTCCAGCCCCGTGYAGGCCA | Neurodegeneration with brain iron accumulation 6 |
| 267606740 | COG4 | NM_015386.2(COG4): c.2197C>T (p.Arg733Trp) | CCGAGACAAGTTTGCCYGGCTCT | Congenital disorder of glycosylation type 2J |
| 121912946 | COL11A2 | NM_080680.2(COL11A2): c.4322G>A (p.Gly1441Glu) | CCCTGRGCAGAAGGGTGAGATGG | Weissenbacher-Zweymuller syndrome |
| 121912947 | COL11A2 | NM_080680.2(COL11A2): c.3100C>T (p.Arg1034Cys) | CCCATTGGTCCGCCAGGGYGCCC, CCATTGGTCCGCCAGGGYGCCCA | Deafness, autosomal dominant 13 |
| 121912951 | COL11A2 | NM_080680.2(COL11A2): c.3991C>T (p.Arg1331Ter) | CCTGGTTCCGAGGGGYGACAAGG | |
| 200487396 | COL12A1 | NM_004370.5(COL12A1): c.5893C>T (p.Arg1965Cys) | ACAACGCRATATTGCAGCACAGG | BETHLEM MYOPATHY 2 |
| 796052094 | COL12A1 | NM_004370.5(COL12A1): c.8357G>A (p.Gly2786Asp) | CCAGRCCCCAGGGTCCTCCAGG | BETHLEM MYOPATHY 2 |
| 121912773 | COL17A1 | NM_000494.3(COL17A1): c.1898G>A (p.Gly633Asp) | CGTGRTGAGGCAGGGCCTCCTGG | Adult junctional epidermolysis bullosa |
| 121912769 | COL17A1 | NM_000494.3(COL17A1): c.3676C>T (p.Arg1226Ter) | CCTGGTCCCCAGGGGCCTYGAGG | Adult junctional epidermolysis bullosa, Epidermolysis bullosa, junctional, localisata variant |
| 72648320 | COL1A1 | NM_000088.3(COL1A1): c.1200+1G>A | GCCAATRTAAGTATCCTGCCAGG | Osteogenesis imperfecta |
| 72648356 | COL1A1 | NM_000088.3(COL1A1): c.1598G>A (p.Gly533Asp) | AGCTGRTCTGCCTGGTGCCAAGG | Osteogenesis imperfecta, recessive perinatal lethal |
| 72651646 | COL1A1 | NM_000088.3(COL1A1): c.2156G>A (p.Gly719Asp) | CCCGRTAGCCAGGGCGCCCCTGG | Osteogenesis imperfecta, recessive perinatal lethal |
| 72651651 | COL1A1 | NM_000088.3(COL1A1): c.2210G>A (p.Gly737Asp) | GCTGRTCTTCCAGGGCCTAAGGG, AGCTGRTCTTCCAGGGCCTAAGG | Osteogenesis imperfecta, recessive perinatal lethal |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72653131 | COL1A1 | NM_000088.3(COL1A1): c.2515G>A (p.Gly839Ser) | GCTRGTCCCCCTGGCCCTGCCGG | Osteogenesis imperfecta type III |
| 72653136 | COL1A1 | NM_000088.3(COL1A1): c.2533G>A (p.Gly845Arg) | GCCRGACCCGCTGGACCCCCTGG | Osteogenesis imperfecta, recessive perinatal lethal |
| 72653137 | COL1A1 | NM_000088.3(COL1A1): c.2552G>A (p.Gly851Asp) | CCCCCTGRCCCCATTGTGAGTGG | Osteogenesis imperfecta, recessive perinatal lethal |
| 72653169 | COL1A1 | NM_000088.3(COL1A1): c.3028G>A (p.Gly1010Ser) | CCCTRGTGAATCTGGACGTGAGG | Osteogenesis imperfecta with normal sclerae, dominant form |
| 72653172 | COL1A1 | NM_000088.3(COL1A1): c.3073G>A (p.Gly1025Arg) | CCTRGACGAGACGGTTCTCCTGG | Osteogenesis imperfecta, recessive perinatal lethal |
| 72653178 | COL1A1 | NM_000088.3(COL1A1): c.3118G>A (p.Gly1040Ser) | ACCRGCCCCGCTGGACCCCCTGG | Osteogenesis imperfecta type III |
| 72654797 | COL1A1 | NM_000088.3(COL1A1): c.3182G>A (p.Gly1061Asp) | GCTGRCAAGAGTGGTGATCGTGG | Osteogenesis imperfecta, recessive perinatal lethal |
| 72654802 | COL1A1 | NM_000088.3(COL1A1): c.3235G>A (p.Gly1079Ser) | GTCRGCCCTGTTGGCGCCCGTGG | Osteogenesis imperfecta type I |
| 72656306 | COL1A1 | NM_000088.3(COL1A1): c.3271G>A (p.Gly1091Ser) | CAARGCCCCGTGGTGACAAGGG, CCAARGCCCCGTGGTGACAAGG | Osteogenesis imperfecta, recessive perinatal lethal |
| 72656330 | COL1A1 | NM_000088.3(COL1A1): c.3541G>A (p.Gly1181Ser) | CCCRGCCCTCCTGGACCTCCTGG | Osteogenesis imperfecta, recessive perinatal lethal |
| 66523073 | COL1A1 | NM_000088.3(COL1A1): c.3064G>A (p.Gly1022Ser) | GAARGTTCCCCTGGACGAGACGG | Osteogenesis imperfecta type III |
| 72645320 | COL1A1 | NM_000088.3(COL1A1): c.761G>A (p.Gly254Glu) | CGAGRATTGCCCGGAACAGCTGG | Osteogenesis imperfecta type III |
| 72645333 | COL1A1 | NM_000088.3(COL1A1): c.824G>A (p.Gly275Asp) | GATGRTGCCAAGGGAGATGCTGG | Osteogenesis imperfecta, recessive perinatal lethal |
| 72645357 | COL1A1 | NM_000088.3(COL1A1): c.994G>A (p.Gly332Arg) | TGCCRGGCCCCTGTGAGTGTGG | Osteogenesis imperfecta, Osteogenesis imperfecta type III |
| 72653170 | COL1A1 | NM_000088.3(COL1A1): c.3040C>T (p.Arg1014Cys) | CCCCCTGGTGAATCTGGAYGTGA, CCCCTGGTGAATCTGGAYGTGAG, CCCTGGTGAATCTGGAYGTGAGG, CCTGGTGAATCTGGAYGTGAGGT | Infantile cortical hyperostosis |
| 72653173 | COL1A1 | NM_000088.3(COL1A1): c.3076C>T (p.Arg1026Ter) | CCGAAGGTTCCCCTGGAYGAGAC | Osteogenesis imperfecta |
| 72645347 | COL1A1 | NM_000088.3(COL1A1): c.934C>T (p.Arg312Cys) | CCTGCCTGGTGAGAGAGGTYGCC, CCTGGTGAGAGAGGTYGCCCTGG | Ehlers-Danlos syndrome, classic type |
| 72658152 | COL1A2 | NM_000089.3(COL1A2): c.1981G>A (p.Gly661Ser) | CCTRGTCTCAGAGGTGAAATTGG | Osteoporosis |
| 72658161 | COL1A2 | NM_000089.3(COL1A2): c.2099G>A (p.Gly700Asp) | GCTGRTCCTGCTGGTCCTGCTGG | Osteogenesis imperfecta type III, Osteogenesis imperfecta with normal sclerae, dominant form |
| 72658176 | COL1A2 | NM_000089.3(COL1A2): c.2251G>A (p.Gly751Ser) | AACRGTGTTGTTGGTCCCACAGG | Osteogenesis imperfecta type III |
| 72658200 | COL1A2 | NM_000089.3(COL1A2): c.2575G>A (p.Gly859Ser) | CCTRGCACTCCAGGTCCTCAGGG, TCCTRGCACTCCAGGTCCTCAGG | Osteogenesis imperfecta type III |
| 72659338 | COL1A2 | NM_000089.3(COL1A2): c.3295G>A (p.Gly1099Arg) | CCTRGACCTCCAGGTGTAAGCGG | Osteogenesis imperfecta type III |
| 121912900 | COL1A2 | NM_000089.3(COL1A2): c.2720G>A (p.Gly907Asp) | CGTGRTCCTCCTGGTGCTGTGGG, CCGTGRTCCTCCTGGTGCTGTGG | Osteogenesis imperfecta, recessive perinatal lethal |
| 121912901 | COL1A2 | NM_000089.3(COL1A2): c.1640G>A (p.Gly547Asp) | CAGGRTCCCCCTGGTCCTCCAGG | Osteogenesis imperfecta, recessive perinatal lethal |
| 121912902 | COL1A2 | NM_000089.3(COL1A2): c.2593G>A (p.Gly865Ser) | CAGRGTCTTCTTGGTGCTCCTGG | Osteogenesis imperfecta, recessive perinatal lethal |
| 121912904 | COL1A2 | NM_000089.3(COL1A2): c.2414G>A (p.Gly805Asp) | TCTGRCCCTCCTGGTCCCCCTGG | Osteogenesis imperfecta, recessive perinatal lethal |
| 121912909 | COL1A2 | NM_000089.3(COL1A2): c.1739G>A (p.Gly580Asp) | TTTGRTCTCCCTGGTCCTGCTGG | Osteogenesis imperfecta, recessive perinatal lethal |
| 121912910 | COL1A2 | NM_000089.3(COL1A2): c.1504G>A (p.Gly502Ser) | TAGRGTGATCCTGGCAAAAACGG | Osteogenesis imperfecta, recessive perinatal lethal |
| 267606741 | COL1A2 | NM_000089.3(COL1A2): c.1262G>A (p.Gly421Asp) | CCTGRTAGTCGTGGTGCAAGTGG | Osteogenesis imperfecta, recessive perinatal lethal |
| 267606742 | COL1A2 | NM_000089.3(COL1A2): c.3269G>A (p.Gly1090Asp) | CAGGRCCCCCTGGTCCCCCTGG | Osteogenesis imperfecta type III |
| 72656387 | COL1A2 | NM_000089.3(COL1A2): c.838G>A (p.Gly280Ser) | GCCRGTCCCCGTGGTGAAGTGGG, CGCCRGTCCCCGTGGTGAAGTGG | Osteogenesis imperfecta |
| 121912864 | COL2A1 | NM_001844.4(COL2A1): c.3220G>A (p.Gly1074Ser) | CCTRGCTCCCCTGGCCCCGCTGG | Hypochondrogenesis |
| 121912867 | COL2A1 | NM_001844.4(COL2A1): c.2320G>A (p.Gly774Ser) | AAARGCCCTGAGGGAGCCCCTGG | Hypochondrogenesis |
| 121912872 | COL2A1 | NM_001844.4(COL2A1): c.800G>A (p.Gly267Asp) | AAGGGRTCCGCCTGGTCCTCAGG | STICKLER SYNDROME, TYPE I, NONSYNDROMIC OCULAR |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912877 | COL2A1 | NM_001844.4(COL2A1): c.908G>A (p.Gly303Asp) | GGCGGRTGCTCCTGGTGTGAAGG | Stickler syndrome type 1, Kniest dysplasia |
| 121912878 | COL2A1 | NM_001844.4(COL2A1): c.2905G>A (p.Gly969Ser) | GAARGTCCACCAGGTCCCCAGGG, CGAARGTCCACCAGGTCCCCAGG | Achondrogenesis type 2 |
| 121912888 | COL2A1 | NM_001844.4(COL2A1): c.1547G>A (p.Gly516Asp) | CGCGRTTTCCCAGGTCAAGATGG | Achondrogenesis type 2 |
| 121912891 | COL2A1 | NM_001844.4(COL2A1): c.3508G>A (p.Gly1170Ser) | GTCRGTCCCTCTGGCAAAGATGG | Coxa plana |
| 121912894 | COL2A1 | NM_001844.4(COL2A1): c.952G>A (p.Gly318Arg) | GAACRGATCTCCGGGCCCAATGG | Rhegmatogenous retinal detachment, autosomal dominant |
| 121912896 | COL2A1 | NM_001844.4(COL2A1): c.141G>A (p.Trp47Ter) | TGTGRAAGCCGGAGCCCTGCCGG | STICKLER SYNDROME, TYPE I, NONSYNDROMIC OCULAR |
| 138498898 | COL2A1 | NM_001844.4(COL2A1): c.4148C>T (p.Thr1383Met) | CTTCCRTGGACAGCAGGCGTAGG | |
| 121912868 | COL2A1 | NM_001844.4(COL2A1): c.3158G>A (p.Gly1053Glu) | CTGRAGTCAAGGTGAGTGTCTGG | Hypochondrogenesis |
| 387906558 | COL2A1 | NM_001844.4(COL2A1): c.2149G>A (p.Gly717Ser) | CAGRGTCCCCGTGGCCTCCCCGG | |
| 121912865 | COL2A1 | NM_001844.4(COL2A1): c.2155C>T (p.Arg719Cys) | CCAGGGCCTCCAGGGTCCCYGTG | Osteoarthritis with mild chondrodysplasia |
| 121912882 | COL2A1 | NM_001844.4(COL2A1): c.2710C>T (p.Arg904Cys) | CCCTGGAGCTGCTGGCYGCGTTG, CCTGGAGCTGCTGGCYGCGTTGG | Epiphyseal dysplasia, multiple, with myopia and conductive deafness |
| 113871730 | COL3A1 | NM_000090.3(COL3A1): c.926G>A (p.Gly309Glu) | GAGRACGGCCAGGACTTCCTGGG, CGAGRACGGCCAGGACTTCCTGG | Ehlers-Danlos syndrome, type 4 |
| 113485686 | COL3A1 | NM_000090.3(COL3A1): c.2356G>A (p.Gly786Arg) | CCCRGACTTCCAGGTATAGCTGG | Ehlers-Danlos syndrome, type 4, Ehlers-Danlos syndrome type 4 variant |
| 121912916 | COL3A1 | NM_000090.3(COL3A1): c.3041G>A (p.Gly1014Glu) | CAGGRAAACCCTGGATCAGATGG | Ehlers-Danlos syndrome, type 4 |
| 121912919 | COL3A1 | NM_000090.3(COL3A1): c.907G>A (p.Gly303Arg) | AGARGGGCTCCTGGTGAGCGAGG | Ehlers-Danlos syndrome, type 4 |
| 121912920 | COL3A1 | NM_000090.3(COL3A1): c.2410G>A (p.Gly804Ser) | ACTRGCCCTCCAGGACCTGCTGG | |
| 121912921 | COL3A1 | NM_000090.3(COL3A1): c.1997G>A (p.Gly666Asp) | GCCRGTGCACCTGGAGCTCCAGG | Ehlers-Danlos syndrome, type 4 |
| 121912924 | COL3A1 | NM_000090.3(COL3A1): c.3302G>A (p.Gly1101Glu) | CGTGRAGCTGCTGGCATCAAAGG | Ehlers-Danlos syndrome, type 4 |
| 587779419 | COL3A1 | NM_000090.3(COL3A1): c.1033G>A (p.Gly345Arg) | CCCTRGATCCCTGGTGCTAAGG | Ehlers-Danlos syndrome, type 4 |
| 587779432 | COL3A1 | NM_000090.3(COL3A1): c.2780G>A (p.Gly927Asp) | GCTGRCCAACCAGGAGAGAAGGG, TGCTGRCCAACCAGGAGAGAAGG | Ehlers-Danlos syndrome, type 4 |
| 587779434 | COL3A1 | NM_000090.3(COL3A1): c.2861G>A (p.Gly954Glu) | ACTGRAGCACGGGGTCTTGCAGG | Ehlers-Danlos syndrome, type 4 |
| 587779437 | COL3A1 | NM_000090.3(COL3A1): c.2140G>A (p.Gly714Arg) | CCTRGGCCACCTGGTGCTGCTGG | Ehlers-Danlos syndrome, type 4 |
| 587779438 | COL3A1 | NM_000090.3(COL3A1): c.2824G>A (p.Gly942Arg) | TAGRGAGCTCCAGGCCCACTTGG | Ehlers-Danlos syndrome, type 4 |
| 587779439 | COL3A1 | NM_000090.3(COL3A1): c.3301G>A (p.Gly1101Arg) | CGTRGAGCTGCTGGCATCAAAGG | Ehlers-Danlos syndrome, type 4 |
| 587779446 | COL3A1 | NM_000090.3(COL3A1): c.556G>A (p.Gly186Ser) | CCTRGTACATCTGGTCATCCTGG | Ehlers-Danlos syndrome, type 4 |
| 587779447 | COL3A1 | NM_000090.3(COL3A1): c.2842G>A (p.Gly948Arg) | CTTRGGATTGCTGGGATCACTGG | Ehlers-Danlos syndrome, type 4 |
| 587779456 | COL3A1 | NM_000090.3(COL3A1): c.2978G>A (p.Gly993Asp) | CGTRGTCCCCCTGGACCCCAGGG, ACGTRGTCCCCCTGGACCCCAGG | Ehlers-Danlos syndrome, type 4 |
| 587779466 | COL3A1 | NM_000090.3(COL3A1): c.2564G>A (p.Gly855Asp) | CCTRGTCCCCAAGGTGTCAAAGG | Ehlers-Danlos syndrome, type 4 |
| 587779472 | COL3A1 | NM_000090.3(COL3A1): c.3473G>A (p.Gly1158Asp) | CAGRTCCCATTGGACCACCAGGG, CCAGRTCCCATTGGACCACCAGG | Ehlers-Danlos syndrome, type 4 |
| 587779474 | COL3A1 | NM_000090.3(COL3A1): c.2068G>A (p.Gly690Arg) | GCARGGGCCCCAGGACTTAGAGG | Ehlers-Danlos syndrome, type 4 |
| 587779476 | COL3A1 | NM_000090.3(COL3A1): c.1466G>A (p.Gly489Glu) | CCTGRGTTCCGAGGACCTGCTGG | Ehlers-Danlos syndrome, type 4 |
| 587779478 | COL3A1 | NM_000090.3(COL3A1): c.809G>A (p.Gly270Glu) | GATGRACGAAATGGAGAAAAGGG, CGATGRACGAAATGGAGAAAAGG | Ehlers-Danlos syndrome, type 4 |
| 587779482 | COL3A1 | NM_000090.3(COL3A1): c.3508G>A (p.Gly1170Ser) | CAGARGTGAAAGAGGATCTGAGG | Ehlers-Danlos syndrome, type 4 |
| 587779484 | COL3A1 | NM_000090.3(COL3A1): c.2203G>A (p.Gly735Arg) | CTTRGAAGTCCTGGTCCAAAGGG, TCTTRGAAGTCCTGGTCCAAAGG | Ehlers-Danlos syndrome, type 4 |
| 587779493 | COL3A1 | NM_000090.3(COL3A1): c.1979G>A (p.Gly660Asp) | CAGGRTCCAAAGGGTGATGCCGG | Ehlers-Danlos syndrome, type 4 |
| 587779494 | COL3A1 | NM_000090.3(COL3A1): c.2555G>A (p.Gly852Asp) | TAGGRTCCTCCTGGTCCCCAAGG | Ehlers-Danlos syndrome, type 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779495 | COL3A1 | NM_000090.3(COL3A1): c.3437G>A (p.Gly1146Glu) | AGTGRACCTCCTGGCAAAGATGG | Ehlers-Danlos syndrome, type 4 |
| 587779499 | COL3A1 | NM_000090.3(COL3A1): c.1087G>A (p.Gly363Ser) | AATRGTGCCCCTGGACAAAGAGG | Ehlers-Danlos syndrome, type 4 |
| 587779501 | COL3A1 | NM_000090.3(COL3A1): c.3255+5G>A (p.Gly1068_Pro1085del) | CTGTAARTTTTGTCATTTTTTGG | Ehlers-Danlos syndrome, type 4 |
| 587779504 | COL3A1 | NM_000090.3(COL3A1): c.3562G>A (p.Gly1188Arg) | CCTRGACCTCCTGGTGCCCCTGG | Ehlers-Danlos syndrome, type 4 |
| 587779505 | COL3A1 | NM_000090.3(COL3A1): c.2708G>A (p.Gly903Glu) | GATGRGCCCCAGGTCCTGCGGG, GGATGRGCCCCAGGTCCTGCGG | Ehlers-Danlos syndrome, type 4 |
| 587779511 | COL3A1 | NM_000090.3(COL3A1): c.2888G>A (p.Gly963Asp) | CCAGRCATGCCAGGTCCTAGGGG, ACCAGRCATGCCAGGTCCTAGGG, CACCAGRCATGCCAGGTCCTAGG | Ehlers-Danlos syndrome, type 4 |
| 587779517 | COL3A1 | NM_000090.3(COL3A1): c.2825G>A (p.Gly942Glu) | AGGRAGCTCCAGGCCCACTTGGG, TAGGRAGCTCCAGGCCCACTTGG | Ehlers-Danlos syndrome, type 4 |
| 587779526 | COL3A1 | NM_000090.3(COL3A1): c.2510G>A (p.Gly837Asp) | GGAGRCCCTCCTGGAGTTGCAGG | Ehlers-Danlos syndrome, type 4 |
| 587779536 | COL3A1 | NM_000090.3(COL3A1): c.3391G>A (p.Gly1131Ser) | ATCRGCAGTCCAGGACCTGCAGG | Ehlers-Danlos syndrome, type 4 |
| 587779538 | COL3A1 | NM_000090.3(COL3A1): c.1149+5G>A (p.Gly351_Pro383del) | TGTAARTATCATAGTTGAGAGGG, CTGTAARTATCATAGTTGAGAGG | Ehlers-Danlos syndrome, type 4 |
| 587779540 | COL3A1 | NM_000090.3(COL3A1): c.3167G>A (p.Gly1056Asp) | GTCRGTCCAGCTGGAAAGAGTGG | Ehlers-Danlos syndrome, type 4 |
| 587779543 | COL3A1 | NM_000090.3(COL3A1): c.2185G>A (p.Gly729Arg) | CCTRGAGAAAGAGGAGGTCTTGG | Ehlers-Danlos syndrome, type 4 |
| 587779545 | COL3A1 | NM_000090.3(COL3A1): c.3140G>A (p.Gly1047Asp) | CCTGRTCATCCAGGCCCACCTGG | Ehlers-Danlos syndrome, type 4 |
| 587779549 | COL3A1 | NM_000090.3(COL3A1): c.2150G>A (p.Gly717Asp) | CCTGRTGCTGCTGGTACTCCTGG | Ehlers-Danlos syndrome, type 4 |
| 587779554 | COL3A1 | NM_000090.3(COL3A1): c.3220G>A (p.Gly1074Ser) | GCTRGTGCTCCCGGTCCTGCTGG | Ehlers-Danlos syndrome, type 4 |
| 587779557 | COL3A1 | NM_000090.3(COL3A1): c.637G>A (p.Gly213Ser) | CAGRGCCCTCCAGGACCTCCTGG | Ehlers-Danlos syndrome, type 4 |
| 587779561 | COL3A1 | NM_000090.3(COL3A1): c.3319G>A (p.Gly1107Arg) | AAARGACATCGAGGATTCCCTGG | Ehlers-Danlos syndrome, type 4 |
| 587779567 | COL3A1 | NM_000090.3(COL3A1): c.2833G>A (p.Gly945Ser) | CCARGCCCACTTGGGATTGCTGG | Ehlers-Danlos syndrome, type 4 |
| 587779569 | COL3A1 | NM_000090.3(COL3A1): c.1124G>A (p.Gly375Glu) | CAGGRACACGCTGGTGCTCAAGG | Ehlers-Danlos syndrome, type 4 |
| 587779576 | COL3A1 | NM_000090.3(COL3A1): c.2987G>A (p.Gly996Glu) | CCTGRACCCCAGGGTCTTCCTGG | Ehlers-Danlos syndrome, type 4 |
| 587779580 | COL3A1 | NM_000090.3(COL3A1): c.2905G>A (p.Gly969Arg) | AGGRGAAGCCCTGGCCCTCAGGG, TAGGRGAAGCCCTGGCCCTCAGG | Ehlers-Danlos syndrome, type 4 |
| 587779581 | COL3A1 | NM_000090.3(COL3A1): c.2168G>A (p.Gly723Asp) | CCTGRTCTGCAAGGAATGCCTGG | Ehlers-Danlos syndrome, type 4 |
| 587779583 | COL3A1 | NM_000090.3(COL3A1): c.2959G>A (p.Gly987Ser) | AACRGTCTCAGTGGAGAACGTGG | Thoracic aortic aneurysms and aortic dissections, Ehlers-Danlos syndrome, type 4 |
| 587779584 | COL3A1 | NM_000090.3(COL3A1): c.1618G>A (p.Gly540Arg) | CCCRGAAGTCCAGGAGGACCAGG | Thoracic aortic aneurysms and aortic dissections, Ehlers-Danlos syndrome, type 4 |
| 587779586 | COL3A1 | NM_000090.3(COL3A1): c.1268G>A (p.Gly423Asp) | AATGRTGCTCCTGGACTGCGAGG | Ehlers-Danlos syndrome, type 4 |
| 587779591 | COL3A1 | NM_000090.3(COL3A1): c.2087G>A (p.Gly696Asp) | AGAGRTGGAGCTGGTCCCCCTGG | Ehlers-Danlos syndrome, type 4 |
| 587779593 | COL3A1 | NM_000090.3(COL3A1): c.836G>A (p.Gly279Asp) | AACAGRTGCTCCTGGATTAAAGG | Ehlers-Danlos syndrome, type 4 |
| 587779595 | COL3A1 | NM_000090.3(COL3A1): c.2933G>A (p.Gly978Asp) | CAGGRTGAAAGTGGGAAACCAGG | Ehlers-Danlos syndrome, type 4 |
| 587779596 | COL3A1 | NM_000090.3(COL3A1): c.647G>A (p.Gly216Glu) | CCAGRACCTCCTGGTGCTATAGG | Ehlers-Danlos syndrome, type 4 |
| 587779599 | COL3A1 | NM_000090.3(COL3A1): c.2699G>A (p.Gly900Asp) | CCAGRCAAGGATGGGCCCCCAGG | Ehlers-Danlos syndrome, type 4 |
| 587779601 | COL3A1 | NM_000090.3(COL3A1): c.592G>A (p.Gly198Arg) | CCARGATACCAAGGACCCCCTGG | Ehlers-Danlos syndrome, type 4 |
| 587779606 | COL3A1 | NM_000090.3(COL3A1): c.2194G>A (p.Gly732Arg) | AGARGAGGTCTTGGAAGTCCTGG | Ehlers-Danlos syndrome, type 4 |
| 587779610 | COL3A1 | NM_000090.3(COL3A1): c.3284G>A (p.Gly1095Asp) | AAAGRTGAAACAGGTGAACGTGG | Ehlers-Danlos syndrome, type 4 |
| 587779611 | COL3A1 | NM_000090.3(COL3A1): c.1898G>A (p.Gly633Glu) | ACAGRACCCCCTGGTCCACAAGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779621 | COL3A1 | NM_000090.3(COL3A1): c.1358G>A (p.Gly453Asp) | GCTGRTATTCCAGGTGTTCCAGG | Ehlers-Danlos syndrome, type 4 |
| 587779625 | COL3A1 | NM_000090.3(COL3A1): c.709G>A (p.Gly237Arg) | CCCRGACGACCTGGAGAGCGAGG | Thoracic aortic aneurysms and aortic dissections, Ehlers-Danlos syndrome, type 4 |
| 587779626 | COL3A1 | NM_000090.3(COL3A1): c.611G>A (p.Gly204Asp) | CCTGRTGAACCTGGGCAAGCTGG | Ehlers-Danlos syndrome, type 4 |
| 587779630 | COL3A1 | NM_000090.3(COL3A1): c.2293G>A (p.Gly765Ser) | ACTRGTCCTATTGGTCCTCCTGG | Ehlers-Danlos syndrome, type 4 |
| 587779631 | COL3A1 | NM_000090.3(COL3A1): c.1267G>A (p.Gly423Ser) | AATRGTGCTCCTGGACTGCGAGG | Ehlers-Danlos syndrome, type 4 |
| 587779633 | COL3A1 | NM_000090.3(COL3A1): c.1384G>A (p.Gly462Ser) | AAARGCGAAGATGGCAAGGATGG, AGCTAAARGCGAAGATGGCAAGG | Ehlers-Danlos syndrome, type 4 |
| 587779634 | COL3A1 | NM_000090.3(COL3A1): c.1844G>A (p.Gly615Glu) | CTGRACCTCAGGGACCCCCAGGG, ACTGRACCTCAGGGACCCCAGGG | Ehlers-Danlos syndrome, type 4 |
| 587779637 | COL3A1 | NM_000090.3(COL3A1): c.1249G>A (p.Gly417Arg) | CCARGACCAGCCGGTGCTAATGG | Ehlers-Danlos syndrome, type 4 |
| 587779638 | COL3A1 | NM_000090.3(COL3A1): c.2176G>A (p.Gly726Arg) | CAARGAATGCCTGGAGAAAGAGG | Ehlers-Danlos syndrome, type 4 |
| 587779641 | COL3A1 | NM_000090.3(COL3A1): c.593G>A (p.Gly198Glu) | CCAGRATACCAAGGACCCCCTGG | Ehlers-Danlos syndrome, type 4 |
| 587779642 | COL3A1 | NM_000090.3(COL3A1): c.2501G>A (p.Gly834Asp) | AAAGRTGAAGGAGGCCCTCCTGG | Ehlers-Danlos syndrome, type 4 |
| 587779644 | COL3A1 | NM_000090.3(COL3A1): c.827G>A (p.Gly276Asp) | AAGGRTGAAACAGGTGCTCCTGG | Ehlers-Danlos syndrome, type 4 |
| 587779648 | COL3A1 | NM_000090.3(COL3A1): c.3419G>A (p.Gly1140Glu) | TAGGRACCTGTTGGACCCAGTGG | Ehlers-Danlos syndrome, type 4 |
| 587779650 | COL3A1 | NM_000090.3(COL3A1): c.970G>A (p.Gly324Ser) | GACRGTGCTCGAGGCAGTGATGG | Ehlers-Danlos syndrome, type 4 |
| 587779656 | COL3A1 | NM_000090.3(COL3A1): c.701G>A (p.Gly234Asp) | TCAGRTAGACCCGACGACCTGG | Ehlers-Danlos syndrome, type 4 |
| 587779662 | COL3A1 | NM_000090.3(COL3A1): c.2753G>A (p.Gly918Glu) | CCTGRAGTGTCTGGACCAAAAGG | Ehlers-Danlos syndrome, type 4 |
| 587779672 | COL3A1 | NM_000090.3(COL3A1): c.3266G>A (p.Gly1089Asp) | CAAGRCCCACGTGGTGACAAAGG | Ehlers-Danlos syndrome, type 4 |
| 587779673 | COL3A1 | NM_000090.3(COL3A1): c.998G>A (p.Gly333Asp) | CAGGRCCCTCCTGGTCCTCCTGG | Ehlers-Danlos syndrome, type 4 |
| 587779674 | COL3A1 | NM_000090.3(COL3A1): c.2860G>A (p.Gly954Arg) | ACTRGAGCACGGGTCTTGCAGG | Ehlers-Danlos syndrome, type 4 |
| 587779678 | COL3A1 | NM_000090.3(COL3A1): c.2141G>A (p.Gly714Glu) | CCTGRGCCACCTGGTGCTGCTGG | Ehlers-Danlos syndrome, type 4 |
| 587779680 | COL3A1 | NM_000090.3(COL3A1): c.2186G>A (p.Gly729Glu) | CCTGRAGAAAGAGGAGGTCTTGG | Ehlers-Danlos syndrome, type 4 |
| 587779683 | COL3A1 | NM_000090.3(COL3A1): c.3544G>A (p.Gly1182Arg) | CCARGGCAACCAGGCCCTCCTGG | Ehlers-Danlos syndrome, type 4 |
| 587779689 | COL3A1 | NM_000090.3(COL3A1): c.2402G>A (p.Gly801Asp) | AGAGRTGAAACTGGCCCTCCAGG | Ehlers-Danlos syndrome, type 4 |
| 587779691 | COL3A1 | NM_000090.3(COL3A1): c.1763G>A (p.Gly588Asp) | TAGGRTGCTCCTGGTAAGAATGG | Ehlers-Danlos syndrome, type 4 |
| 587779692 | COL3A1 | NM_000090.3(COL3A1): c.1258G>A (p.Gly420Ser) | GCCRGTGCTAATGGTGCTCCTGG | Ehlers-Danlos syndrome, type 4 |
| 587779693 | COL3A1 | NM_000090.3(COL3A1): c.1556G>A (p.Gly519Glu) | AGAGRAGCTGCTGGAGAACCTGG | Ehlers-Danlos syndrome, type 4 |
| 587779695 | COL3A1 | NM_000090.3(COL3A1): c.2131G>A (p.Gly711Ser) | GCTRGTCCTCCTGGGCCACCTGG | Ehlers-Danlos syndrome, type 4 |
| 587779696 | COL3A1 | NM_000090.3(COL3A1): c.1096G>A (p.Gly366Arg) | CCTRGACAAAGAGGAGAACCTGG | Ehlers-Danlos syndrome, type 4 |
| 587779698 | COL3A1 | NM_000090.3(COL3A1): c.2177G>A (p.Gly726Glu) | CAAGRAATGCCTGGAGAAAGAGG | Ehlers-Danlos syndrome, type 4 |
| 587779706 | COL3A1 | NM_000090.3(COL3A1): c.2096G>A (p.Gly699Asp) | GCTGRTCCCCCTGGTCCCGAAGG | Ehlers-Danlos syndrome, type 4 |
| 587779711 | COL3A1 | NM_000090.3(COL3A1): c.610G>A (p.Gly204Ser) | CCTRGTGAACCTGGGCAAGCTGG | Ehlers-Danlos syndrome, type 4 |
| 587779714 | COL3A1 | NM_000090.3(COL3A1): c.539G>A (p.Gly180Asp) | CCAGRCCCTCCCGGTCCCCCTGG | Ehlers-Danlos syndrome, type 4 |
| 587779716 | COL3A1 | NM_000090.3(COL3A1): c.2735G>A (p.Gly912Asp) | ACTGRTGCTCCTGGCAGCCCTGG | Ehlers-Danlos syndrome, type 4 |
| 587779718 | COL3A1 | NM_000090.3(COL3A1): c.799G>A (p.Gly267Ser) | TAGRGCTTCGATGGACGAAATGG | Ehlers-Danlos syndrome, type 4 |
| 587779723 | COL3A1 | NM_000090.3(COL3A1): c.2914G>A (p.Gly972Ser) | CCCTRGCCCTCAGGGTGTCAAGG | Ehlers-Danlos syndrome, type 4 |
| 112456072 | COL3A1 | NM_000090.3(COL3A1): c.3563G>A (p.Gly1188Glu) | CCTGRACCTCCTGGTGCCCCTGG | Ehlers-Danlos syndrome, type 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794728060 | COL3A1 | NM_000090.3(COL3A1): c.4087C>T (p.Arg1363Ter) | CCTTCGACTTCTCTCCAGCYGAG | Thoracic aortic aneurysms and aortic dissections |
| 587779527 | COL3A1 | NM_000090.3(COL3A1): c.1786C>T (p.Arg596Ter) | CCTGGTAAGAATGGAGAAYGAGG | Ehlers-Danlos syndrome, type 4 |
| 672601346 | COL4A1 | NM_001845.5(COL4A1): c.2263G>A (p.Gly755Arg) | CCCRGGAGAAGGGGAGCATTGG | Brain small vessel disease with hemorrhage |
| 672601349 | COL4A1 | NM_001845.5(COL4A1): c.2122G>A (p.Gly708Arg) | ATGRGGCCACCGGGGACTCCAGG | Brain small vessel disease with hemorrhage |
| 121912857 | COL4A1 | NM_001845.5(COL4A1): c.1685G>A (p.Gly562Glu) | CCTGRAAGAGATGGCCATCCGGG, TCCTGRAAGAGATGGCCATCCGG | Brain small vessel disease with hemorrhage |
| 606231465 | COL4A1 | NM_001845.5(COL4A1): c.2194-1G>A | TTTCARGGAGAGCCTGGAGTTGG | Brain small vessel disease with hemorrhage |
| 113994105 | COL4A1 | NM_001845.5(COL4A1): c.1555G>A (p.Gly519Arg) | CCARGGCTGATAGGCCAGCCAGG | Angiopathy, hereditary, with nephropathy, aneurysms, and muscle cramps |
| 113994107 | COL4A1 | NM_001845.5(COL4A1): c.1769G>A (p.Gly590Glu) | CCTGGAGRAGTTGGATTCCCAGG | Brain small vessel disease with hemorrhage |
| 113994108 | COL4A1 | NM_001845.5(COL4A1): c.2159G>A (p.Gly720Asp) | AATGRCTTACCTGGGAACCCAGG | Brain small vessel disease with hemorrhage |
| 113994109 | COL4A1 | NM_001845.5(COL4A1): c.2245G>A (p.Gly749Ser) | CCCRGCATTCCTGGCACACCCGG | Familial porencephaly |
| 113994111 | COL4A1 | NM_001845.5(COL4A1): c.3389G>A (p.Gly1130Asp) | CCTGRTGTCAAAGGAGAAGCAGG | Familial porencephaly |
| 113994112 | COL4A1 | NM_001845.5(COL4A1): c.3706G>A (p.Gly1236Arg) | AAARGAGACCGCGGACCTCAGGG, CAAARGAGACCGCGGACCTCAGG | Familial porencephaly |
| 587777379 | COL4A1 | NM_001845.5(COL4A1): c.3976G>A (p.Gly1326Arg) | CCTTGATCACCTTTAATTCYCTG | Schizencephaly |
| 387906602 | COL4A2 | NM_001846.2(COL4A2): c.3455G>A (p.Gly1152Asp) | CAGRCTTTCCAGGGCTGACTGGG, CCAGRCTTTCCAGGGCTGACTGG | Porencephaly 2 |
| 387906603 | COL4A2 | NM_001846.2(COL4A2): c.3110G>A (p.Gly1037Glu) | AAGGRAGACATCGGAGTCCCCGG | Porencephaly 2 |
| 121912858 | COL4A4 | NM_000092.4(COL4A4): c.3601G>A (p.Gly1201Ser) | CCTRGTCCAGTGGGAATACCTGG | Alport syndrome, autosomal recessive |
| 121912860 | COL4A4 | NM_000092.4(COL4A4): c.2690G>A (p.Gly897Glu) | GATGRGCTACCTGGTCCTCCAGG | Benign familial hematuria |
| 281874656 | COL4A5 | NM_000495.4(COL4A5): c.1084G>A (p.Gly362Arg) | ATTRGGTTGCCTGGGTTGCCTGG | Alport syndrome, X-linked recessive |
| 281874660 | COL4A5 | NM_000495.4(COL4A5): c.1216G>A (p.Gly406Ser) | AGGRGTCAGAAAGGTGATGAAGG | Alport syndrome, X-linked recessive |
| 281874663 | COL4A5 | NM_000495.4(COL4A5): c.1259G>A (p.Gly420Glu) | CCTGRACCTCCTGGACTTGACGG | Alport syndrome, X-linked recessive |
| 281874664 | COL4A5 | NM_000495.4(COL4A5): c.1294G>A (p.Gly432Arg) | CCTRGGCTTCCAGGGCCTCCTGG | Alport syndrome, X-linked recessive |
| 281874669 | COL4A5 | NM_000495.4(COL4A5): c.142G>A (p.Gly48Arg) | CAGRGAGAGAGAGGGTTTCCAGG | Alport syndrome, X-linked recessive |
| 281874671 | COL4A5 | NM_000495.4(COL4A5): c.1589G>A (p.Gly530Asp) | CAGGRCATTCCAGGAGCTCCAGG | Alport syndrome, X-linked recessive |
| 281874672 | COL4A5 | NM_000495.4(COL4A5): c.1598G>A (p.Gly533Glu) | CCAGRAGCTCCAGGTGCTCCAGG | Alport syndrome, X-linked recessive |
| 281874675 | COL4A5 | NM_000495.4(COL4A5): c.1726G>A (p.Gly576Ser) | CCTRGCACTCCTGGACAGGATGG, TTTACCTRGCACTCCTGGACAGG | Alport syndrome, X-linked recessive |
| 281874677 | COL4A5 | NM_000495.4(COL4A5): c.1744G>A (p.Gly582Arg) | GATRGATTGCCAGGGCTTCCTGG | Alport syndrome, X-linked recessive |
| 281874680 | COL4A5 | NM_000495.4(COL4A5): c.1835G>A (p.Gly612Asp) | CAGRCCTCCCAGGGAATATAGGG, CCAGRCCTCCCAGGGAATATAGG | Alport syndrome, X-linked recessive |
| 281874683 | COL4A5 | NM_000495.4(COL4A5): c.1904G>A (p.Gly635Asp) | AAAGRCATACAAGGTGTGGCAGG, TGAAAAAGRCATACAAGGTGTGG | Alport syndrome, X-linked recessive |
| 281874689 | COL4A5 | NM_000495.4(COL4A5): c.2288G>A (p.Gly763Glu) | CCAGRACTTCCAGGTTTCAAAGG | Alport syndrome, X-linked recessive |
| 281874690 | COL4A5 | NM_000495.4(COL4A5): c.2305G>A (p.Gly769Arg) | AAARGAGCACTTGGTCCAAAAGG | Alport syndrome, X-linked recessive |
| 281874695 | COL4A5 | NM_000495.4(COL4A5): c.2483G>A (p.Gly828Glu) | CCAGRGATTCCTGGGCCAATAGG | Alport syndrome, X-linked recessive |
| 281874703 | COL4A5 | NM_000495.4(COL4A5): c.2722G>A (p.Gly908Arg) | CCARGACCTTTGGGAATTCCTGG | Alport syndrome, X-linked recessive |
| 281874704 | COL4A5 | NM_000495.4(COL4A5): c.2731G>A (p.Gly911Arg) | TTGRAATTCCTGGCAGGAGTGG, GACCTTTGRGAATTCCTGGCAGG | Alport syndrome, X-linked recessive |
| 281874706 | COL4A5 | NM_000495.4(COL4A5): c.286G>A (p.Gly96Arg) | CCTRGACTTCCTGGATTTCCAGG | Alport syndrome, X-linked recessive |
| 281874717 | COL4A5 | NM_000495.4(COL4A5): c.3587G>A (p.Gly1196Glu) | CCTGRACTTCCAGGACTTTCTGG | Alport syndrome, X-linked recessive |
| 281874722 | COL4A5 | NM_000495.4(COL4A5): c.385G>A (p.Gly129Arg) | TAGRGAGAACGTGGATTTCCAGG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281874725 | COL4A5 | NM_000495.4(COL4A5): c.3925-1G>A | TCARGGTAATCCTGGCCGGCCGG, TTATTCARGGTAATCCTGGCCGG | Alport syndrome, X-linked recessive |
| 281874733 | COL4A5 | NM_000495.4(COL4A5): c.4271G>A (p.Gly1424Glu) | AAAGRAGACCCAGGTCTGCCAGG | Alport syndrome, X-linked recessive |
| 281874739 | COL4A5 | NM_000495.4(COL4A5): c.438+5G>A | TCCAGTAARTTATAAAATTTGGG | Alport syndrome, X-linked recessive |
| 281874746 | COL4A5 | NM_000495.4(COL4A5): c.4702G>A (p.Glu1568Lys) | AGTATGTRAAGCTCCAGCTGTGG | Alport syndrome, X-linked recessive |
| 281874763 | COL4A5 | NM_000495.4(COL4A5): c.689G>A (p.Gly230Asp) | CAGGRTGAGCAAGGTCTTCAGGG, ACAGGRTGAGCAAGGTCTTCAGG | Alport syndrome, X-linked recessive |
| 104886080 | COL4A5 | NM_000495.4(COL4A5): c.892G>A (p.Gly298Ser) | TAGRGTAAACCAGGCAAAGATGG | Alport syndrome, X-linked recessive |
| 104886381 | COL4A5 | NM_000495.4(COL4A5): c.3554-1G>A | CTGACARGTCAACCAGGCTTTGG | Alport syndrome, X-linked recessive |
| 587776402 | COL4A5 | NM_000495.4(COL4A5): c.4199-1G>A | GTARGTCCAACTGGCCCTCCAGG | Alport syndrome, X-linked recessive |
| 104886043 | COL4A5 | NM_000495.4(COL4A5): c.161G>A (p.Gly54Asp) | CCAGRTTTGGAAGGACACCCAGG | Alport syndrome, X-linked recessive |
| 104886057 | COL4A5 | NM_000495.4(COL4A5): c.593G>A (p.Gly198Glu) | CCCAGRACCACCAGGTTTGATGG | Alport syndrome, X-linked recessive |
| 104886060 | COL4A5 | NM_000495.4(COL4A5): c.574G>A (p.Gly192Arg) | CCARGGCCAATTGGTCCCCCAGG | Alport syndrome, X-linked recessive |
| 104886061 | COL4A5 | NM_000495.4(COL4A5): c.584G>A (p.Gly195Asp) | ATTGRTCCCCCAGGACCACCAGG | Alport syndrome, X-linked recessive |
| 104886070 | COL4A5 | NM_000495.4(COL4A5): c.791G>A (p.Gly264Asp) | CCTGRTGACCGAGGGCCTCCTGG | Alport syndrome, X-linked recessive |
| 104886075 | COL4A5 | NM_000495.4(COL4A5): c.655G>A (p.Gly219Ser) | AATATGRGCTTAAATTTCCAGGG, GAATATGRGCTTAAATTTCCAGG | Alport syndrome, X-linked recessive |
| 104886084 | COL4A5 | NM_000495.4(COL4A5): c.937G>A (p.Gly313Ser) | AAGRGTTTGCCTGGTGATCCTGG | Alport syndrome, X-linked recessive |
| 104886086 | COL4A5 | NM_000495.4(COL4A5): c.956G>A (p.Gly319Asp) | CCTGRTTACCCTGGTGAACCCGG | Alport syndrome, X-linked recessive |
| 104886091 | COL4A5 | NM_000495.4(COL4A5): c.974G>A (p.Gly325Glu) | ACCCGRAAGGGATGGTGAAAAGG | Alport syndrome, X-linked recessive |
| 104886096 | COL4A5 | NM_000495.4(COL4A5): c.1094G>A (p.Gly365Glu) | CCTGRGTTGCCTGGAGAAAAAGG | Alport syndrome, X-linked recessive |
| 104886097 | COL4A5 | NM_000495.4(COL4A5): c.1112G>A (p.Gly371Glu) | AAAGRAGAGCGAGGATTTCCTGG | Alport syndrome, X-linked recessive |
| 104886098 | COL4A5 | NM_000495.4(COL4A5): c.1139G>A (p.Gly380Asp) | CAGGRTCCACCTGGCCTTCCTGG | Alport syndrome, X-linked recessive |
| 104886101 | COL4A5 | NM_000495.4(COL4A5): c.1226G>A (p.Gly409Asp) | AAAGRTGATGAAGGACCACCTGG | Alport syndrome, X-linked recessive |
| 104886103 | COL4A5 | NM_000495.4(COL4A5): c.1243G>A (p.Gly415Arg) | CCACCTRGAATTTCCATTCCTGG | Alport syndrome, X-linked recessive |
| 104886105 | COL4A5 | NM_000495.4(COL4A5): c.1148G>A (p.Gly383Asp) | CCTGRCCTTCCTGGACCTCCAGG | Alport syndrome, X-linked recessive |
| 104886107 | COL4A5 | NM_000495.4(COL4A5): c.1199G>A (p.Gly400Glu) | CCTGRATTTCCTGGAGAAAGGGG, TCCTGRATTTCCTGGAGAAAGGG, CTCCTGRATTTCCTGGAGAAAGG | Alport syndrome, X-linked recessive |
| 104886110 | COL4A5 | NM_000495.4(COL4A5): c.1268G>A (p.Gly423Glu) | CTGRACTTGACGGACAGCCTGGG, CCTGRACTTGACGGACAGCCTGG | Alport syndrome, X-linked recessive |
| 104886111 | COL4A5 | NM_000495.4(COL4A5): c.1276G>A (p.Gly426Arg) | GACRGACAGCCTGGGGCTCCTGG | Alport syndrome, X-linked recessive |
| 104886112 | COL4A5 | NM_000495.4(COL4A5): c.1286G>A (p.Gly429Glu) | CTGRGGCTCCTGGGCTTCCAGGG, CCTGRGGCTCCTGGGCTTCCAGG | Alport syndrome, X-linked recessive |
| 104886114 | COL4A5 | NM_000495.4(COL4A5): c.1397G>A (p.Gly466Glu) | AAAGRACTCCAAGGAGAACAAGG | Alport syndrome, X-linked recessive |
| 104886115 | COL4A5 | NM_000495.4(COL4A5): c.1406G>A (p.Gly469Glu) | CAAGRAGAACAAGGAGTGAAAGG | Alport syndrome, X-linked recessive |
| 104886117 | COL4A5 | NM_000495.4(COL4A5): c.1472G>A (p.Gly491Glu) | TCAGRGCCTCCAGGTCAACCTGG | Alport syndrome, X-linked recessive |
| 104886118 | COL4A5 | NM_000495.4(COL4A5): c.1481G>A (p.Gly494Asp) | CCAGRTCAACCTGGTTTGCCAGG | Alport syndrome, X-linked recessive |
| 104886122 | COL4A5 | NM_000495.4(COL4A5): c.1562G>A (p.Gly521Asp) | GCTGRTGCAACTGGTCCCAAAGG | Alport syndrome, X-linked recessive |
| 104886125 | COL4A5 | NM_000495.4(COL4A5): c.1607G>A (p.Gly536Asp) | CCAGRTGCTCCAGGCTTTCCTGG | Alport syndrome, X-linked recessive |
| 104886130 | COL4A5 | NM_000495.4(COL4A5): c.1736G>A (p.Gly579Glu) | CTGRACAGGATGGATTGCCAGGG, CCTGRACAGGATGGATTGCCAGG | Alport syndrome, X-linked recessive |
| 104886131 | COL4A5 | NM_000495.4(COL4A5): c.1780G>A (p.Gly594Ser) | TAGRGTGGAATTACTTTTAAGGG, TTAGRGTGGAATTACTTTTAAGG | Alport syndrome, X-linked recessive |
| 104886132 | COL4A5 | NM_000495.4(COL4A5): c.1783G>A (p.Gly595Arg) | TAGGGTRGAATTACTTTTAAGGG, TTAGGGTRGAATTACTTTTAAGG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886136 | COL4A5 | NM_000495.4(COL4A5): c.1681G>A (p.Gly561Arg) | AAARGAGAGTTGGGTTCCCCTGG | Alport syndrome, X-linked recessive |
| 104886138 | COL4A5 | NM_000495.4(COL4A5): c.1718G>A (p.Gly573Asp) | CCTGRTTTACCTGGCACTCCTGG | Alport syndrome, X-linked recessive |
| 104886139 | COL4A5 | NM_000495.4(COL4A5): c.1735G>A (p.Gly579Arg) | CCTRGACAGGATGGATTGCCAGG | Alport syndrome, X-linked recessive |
| 104886142 | COL4A5 | NM_000495.4(COL4A5): c.1871G>A (p.Gly624Asp) | CCCCCTGRTTTCGGCCCTCCAGG | Alport syndrome, X-linked recessive |
| 104886144 | COL4A5 | NM_000495.4(COL4A5): c.1886G>A (p.Gly629Asp) | CCAGRCCCAGTAGGTGAAAAAGG | Alport syndrome, X-linked recessive |
| 104886145 | COL4A5 | NM_000495.4(COL4A5): c.1895G>A (p.Gly632Asp) | GTAGRTGAAAAAGGCATACAAGG | Alport syndrome, X-linked recessive |
| 104886146 | COL4A5 | NM_000495.4(COL4A5): c.1897G>A (p.Glu633Lys) | GTAGGTRAAAAAGGCATACAAGG | Alport syndrome, X-linked recessive |
| 104886147 | COL4A5 | NM_000495.4(COL4A5): c.1912G>A (p.Gly638Ser) | CAARGTGTGGCAGGAAATCCAGG | Alport syndrome, X-linked recessive |
| 104886157 | COL4A5 | NM_000495.4(COL4A5): c.2023G>A (p.Gly675Ser) | GATRGTGATGTAGGTCTTCCAGG | Alport syndrome, X-linked recessive |
| 104886158 | COL4A5 | NM_000495.4(COL4A5): c.2042G>A (p.Gly681Asp) | TAGRTGACCCTGGACTTCCAGGG, ATAGRTGACCCTGGACTTCCAGG | Alport syndrome, X-linked recessive |
| 104886163 | COL4A5 | NM_000495.4(COL4A5): c.2165G>A (p.Gly722Glu) | CAGRACCTCCAGGAGCACCTGGG, CCAGRACCTCCAGGAGCACCTGG | Alport syndrome, X-linked recessive |
| 104886165 | COL4A5 | NM_000495.4(COL4A5): c.2219G>A (p.Gly740Glu) | CCTGRGCCACCCGGCTTTCCAGG | Alport syndrome, X-linked recessive |
| 104886166 | COL4A5 | NM_000495.4(COL4A5): c.2228G>A (p.Gly743Asp) | ACCCGRCTTTCCAGGACCAAAGG | Alport syndrome, X-linked recessive |
| 104886168 | COL4A5 | NM_000495.4(COL4A5): c.2060G>A (p.Gly687Glu) | CAGRGCAACCAGGCTTGCCAGGG, CCAGRGCAACCAGGCTTGCCAGG | Alport syndrome, X-linked recessive |
| 104886171 | COL4A5 | NM_000495.4(COL4A5): c.2287G>A (p.Gly763Arg) | CCARGACTTCCAGGTTTCAAAGG | Alport syndrome, X-linked recessive |
| 104886172 | COL4A5 | NM_000495.4(COL4A5): c.2297G>A (p.Gly766Asp) | CCAGRTTTCAAAGGAGCACTTGG | Alport syndrome, X-linked recessive |
| 104886174 | COL4A5 | NM_000495.4(COL4A5): c.2332G>A (p.Gly778Ser) | CGTRGTTTCCCAGGACCTCCGGG, TCGTRGTTTCCCAGGACCTCCGG | Alport syndrome, X-linked recessive |
| 104886177 | COL4A5 | NM_000495.4(COL4A5): c.2386G>A (p.Gly796Arg) | CCCTRGACCAAAAGGTATGGAGG, GCTCCCTRGACCAAAAGGTATGG | Alport syndrome, X-linked recessive |
| 104886179 | COL4A5 | NM_000495.4(COL4A5): c.2404G>A (p.Gly802Arg) | GTTRGACCAAATGGACAACCTGG | Alport syndrome, X-linked recessive |
| 104886180 | COL4A5 | NM_000495.4(COL4A5): c.2423G>A (p.Gly808Glu) | CTGRACCAATGGGACCTCCTGGG, CCTGRACCAATGGGACCTCCTGG | Alport syndrome, X-linked recessive |
| 104886182 | COL4A5 | NM_000495.4(COL4A5): c.2431G>A (p.Gly811Arg) | ATGRGACCTCCTGGGCTGCCAGG | Alport syndrome, X-linked recessive |
| 104886186 | COL4A5 | NM_000495.4(COL4A5): c.2554G>A (p.Gly852Arg) | CCTCCTRGACTTGATGTTCCAGG | Alport syndrome, X-linked recessive |
| 104886187 | COL4A5 | NM_000495.4(COL4A5): c.2555G>A (p.Gly852Glu) | CCTCCTGRACTTGATGTTCCAGG | Alport syndrome, X-linked recessive |
| 104886188 | COL4A5 | NM_000495.4(COL4A5): c.2597G>A (p.Gly866Glu) | CCAGRGATCCCCGGAGCACCTGG | Alport syndrome, X-linked recessive |
| 104886189 | COL4A5 | NM_000495.4(COL4A5): c.2605G>A (p.Gly869Arg) | CCCRGAGCACCTGGTCCTATAGG | Alport syndrome, X-linked recessive |
| 104886191 | COL4A5 | NM_000495.4(COL4A5): c.2624G>A (p.Gly875Glu) | TAGRACCTCCAGGATCACCAGGG, ATAGRACCTCCAGGATCACCAGG | Alport syndrome, X-linked recessive |
| 104886195 | COL4A5 | NM_000495.4(COL4A5): c.2804G>A (p.Gly935Asp) | CCTGRCCCTACAGGAGAAAAAGG | Alport syndrome, X-linked recessive |
| 104886210 | COL4A5 | NM_000495.4(COL4A5): c.3088G>A (p.Gly1030Ser) | ATCRGTGATATGGGTTTTCCAGG | Alport syndrome, X-linked recessive |
| 104886214 | COL4A5 | NM_000495.4(COL4A5): c.3115G>A (p.Gly1039Ser) | CAGRGTGTGGAAGGGCCTCCTGG | Alport syndrome, X-linked recessive |
| 104886215 | COL4A5 | NM_000495.4(COL4A5): c.3134G>A (p.Gly1045Glu) | CCTGRACCTTCTGGAGTTCCTGG | Alport syndrome, X-linked recessive |
| 104886223 | COL4A5 | NM_000495.4(COL4A5): c.3247G>A (p.Gly1083Ser) | CAGRGTGAGCCTGGTCTGCCTGG | Alport syndrome, X-linked recessive |
| 104886225 | COL4A5 | NM_000495.4(COL4A5): c.3319G>A (p.Gly1107Arg) | CCCRGATTACCAGGAACCCCTGG | Alport syndrome, X-linked recessive |
| 104886228 | COL4A5 | NM_000495.4(COL4A5): c.3427G>A (p.Gly1143Ser) | CCCRGCCTTCCAGGAGAACCTGG | Alport syndrome, X-linked recessive |
| 104886229 | COL4A5 | NM_000495.4(COL4A5): c.3428G>A (p.Gly1143Asp) | CCCGRCCTTCCAGGAGAACCTGG | Alport syndrome, X-linked recessive |
| 104886232 | COL4A5 | NM_000495.4(COL4A5): c.3257G>A (p.Gly1086Asp) | CTGRTCTGCCTGGATACCCAGGG, CCTGRTCTGCCTGGATACCCAGG | Alport syndrome, X-linked recessive |
| 104886235 | COL4A5 | NM_000495.4(COL4A5): c.3481G>A (p.Gly1161Arg) | CCARGGCCTCCAGGCGAAAAAGG | Alport syndrome, X-linked recessive |
| 104886236 | COL4A5 | NM_000495.4(COL4A5): c.3499G>A (p.Gly1167Ser) | AAARGCAAACCCGGTCAAGATGG | Alport syndrome, X-linked recessive |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886237 | COL4A5 | NM_000495.4(COL4A5): c.3508G>A (p.Gly1170Ser) | CCCRGTCAAGATGGTATTCCTGG | Alport syndrome, X-linked recessive |
| 104886240 | COL4A5 | NM_000495.4(COL4A5): c.3535G>A (p.Gly1179Arg) | GCTRGACAGAAGGGTGAACCAGG | Alport syndrome, X-linked recessive |
| 104886244 | COL4A5 | NM_000495.4(COL4A5): c.3586G>A (p.Gly1196Arg) | CCTRGACTTCCAGGACTTTCTGG | Alport syndrome, X-linked recessive |
| 104886247 | COL4A5 | NM_000495.4(COL4A5): c.3632G>A (p.Gly1211Glu) | CCTGRGATTCCAGGAAATCCTGG | Alport syndrome, X-linked recessive |
| 104886248 | COL4A5 | NM_000495.4(COL4A5): c.3641G>A (p.Gly1214Glu) | CCAGRAAATCCTGGCCTTCCAGG | Alport syndrome, X-linked recessive |
| 104886250 | COL4A5 | NM_000495.4(COL4A5): c.3694G>A (p.Gly1232Ser) | CCTRGTGTGCAGGGTCCCCCAGG | Alport syndrome, X-linked recessive |
| 104886251 | COL4A5 | NM_000495.4(COL4A5): c.3659G>A (p.Gly1220Asp) | CCAGRTCCAAAGGGCGAACCAGG | Alport syndrome, X-linked recessive |
| 104886253 | COL4A5 | NM_000495.4(COL4A5): c.3686G>A (p.Gly1229Asp) | CACGRTTTCCCTGGTGTGCAGGG, TCACGRTTTCCCTGGTGTGCAGG | Alport syndrome, X-linked recessive |
| 104886257 | COL4A5 | NM_000495.4(COL4A5): c.3808G>A (p.Gly1270Ser) | GAARGTCCTCCAGGTCTCCCTGG | Alport syndrome, X-linked recessive |
| 104886261 | COL4A5 | NM_000495.4(COL4A5): c.3731G>A (p.Gly1244Asp) | TCTCCGGRTCCAGCTCTGGAAGG | Alport syndrome, X-linked recessive |
| 104886262 | COL4A5 | NM_000495.4(COL4A5): c.3754G>A (p.Gly1252Ser) | AAARGCAACCCTGGGCCCCAAGG | Alport syndrome, X-linked recessive |
| 104886263 | COL4A5 | NM_000495.4(COL4A5): c.3763G>A (p.Gly1255Arg) | CCTRGGCCCCAAGGTCCTCCTGG | Alport syndrome, X-linked recessive |
| 104886279 | COL4A5 | NM_000495.4(COL4A5): c.4342G>A (p.Gly1448Ser) | CAARGTCCCCCAGGTCCCCCTGG | Alport syndrome, X-linked recessive |
| 104886297 | COL4A5 | NM_000495.4(COL4A5): c.4787G>A (p.Gly1596Asp) | GATTGRTTATTCCTTCATGATGG | Alport syndrome, X-linked recessive |
| 104886331 | COL4A5 | NM_000495.4(COL4A5): c.1516+1G>A | TCCAGRTAAATTATGCCTCAGGG, CTCCAGRTAAATTATGCCTCAGG | Alport syndrome, X-linked recessive |
| 104886338 | COL4A5 | NM_000495.4(COL4A5): c.1780-1G>A | TTARGGTGGAATTACTTTTAAGG | Alport syndrome, X-linked recessive |
| 104886361 | COL4A5 | NM_000495.4(COL4A5): c.2705G>A (p.Gly902Glu) | ATGGRACCTCCAGGCCCACCAGG | Alport syndrome, X-linked recessive |
| 104886363 | COL4A5 | NM_000495.4(COL4A5): c.2732G>A (p.Gly911Glu) | TTGGRAATTCCTGGCAGGAGTGG | Alport syndrome, X-linked recessive |
| 104886370 | COL4A5 | NM_000495.4(COL4A5): c.2840G>A (p.Gly947Asp) | CCTGRCCTTCCAGGCCCTCCTGG | Alport syndrome, X-linked recessive |
| 104886378 | COL4A5 | NM_000495.4(COL4A5): c.3017-1G>A | CTARGTCCCAAAGGTAACCCTGG | Alport syndrome, X-linked recessive |
| 104886384 | COL4A5 | NM_000495.4(COL4A5): c.3605-1G>A | ATARGCCAAAAGGGTGATGGAGG, TTCATARGCCAAAAGGGTGATGG | Alport syndrome, X-linked recessive |
| 104886396 | COL4A5 | NM_000495.4(COL4A5): c.385-719G>A | CAAGRTGGAGAGAAGGGTATTGG | Alport syndrome, X-linked recessive |
| 794727397 | COL4A5 | NM_000495.4(COL4A5): c.1844G>A (p.Gly615Glu) | CCAGRGAATATAGGGCCTATGGG, CCCAGRGAATATAGGGCCTATGG | Alport syndrome, X-linked recessive |
| 281874676 | COL4A5 | NM_000495.4(COL4A5): c.1738C>T (p.Gln580Ter) | CCTGGCACTCCTGGAYAGGATGG | Alport syndrome, X-linked recessive |
| 281874681 | COL4A5 | NM_000495.4(COL4A5): c.1856C>T (p.Pro619Leu) | CCCAGGGAATATAGGGCYTATGG, CCAGGGAATATAGGGCYTATGGG | Alport syndrome, X-linked recessive |
| 281874727 | COL4A5 | NM_000495.4(COL4A5): c.4147C>T (p.Gln1383Ter) | CCTCCAGGAATCCCTGGCYAGCC, CCAGGAATCCCTGGCYAGCCTGG | Alport syndrome, X-linked recessive |
| 281874661 | COL4A5 | NM_000495.4(COL4A5): c.1219C>T (p.Gln407Ter) | CCTGGAGAAAGGGGTYAGAAAGG | Alport syndrome, X-linked recessive |
| 104886094 | COL4A5 | NM_000495.4(COL4A5): c.1117C>T (p.Arg373Ter) | CCTGGAGAAAAGGAGAGYGAGG | Alport syndrome, X-linked recessive |
| 104886207 | COL4A5 | NM_000495.4(COL4A5): c.3046C>T (p.Gln1016Ter) | CCCTGGTCTCCCTGGAYAGCCAG, CCTGGTCTCCCTGGAYAGCCAGG | Alport syndrome, X-linked recessive |
| 104886213 | COL4A5 | NM_000495.4(COL4A5): c.3181C>T (p.Gln1061Ter) | CCCCAGGATTACCTGGAYAGAAA, CCCAGGATTACCTGGAYAGAAAG, CCAGGATTACCTGGAYAGAAAGG | Alport syndrome, X-linked recessive |
| 104886241 | COL4A5 | NM_000495.4(COL4A5): c.3538C>T (p.Gln1180Ter) | CCTGGACCAGCTGGAYAGAAGGG | Alport syndrome, X-linked recessive |
| 104886270 | COL4A5 | NM_000495.4(COL4A5): c.4228C>T (p.Arg1410Cys) | CCCTCCAGGAGATCCTGGAYGCA, CCTCCAGGAGATCCTGGAYGCAA, CCAGGAGATCCTGGAYGCAATGG | Alport syndrome, X-linked recessive |
| 104886286 | COL4A5 | NM_000495.4(COL4A5): c.4687C>T (p.Arg1563Ter) | CCAGCCATTCATTAGTYGGTAAG | Alport syndrome, X-linked recessive |
| 61735045 | COL5A1 | NM_000093.4(COL5A1): c.1588G>A (p.Gly530Ser) | GGCRGCGATGCGGGCTCCAAAGG | Ehlers-Danlos syndrome, classic type, not specified |
| 121912935 | COL6A1 | NM_001848.2(COL6A1): c.1022G>A (p.Gly341Asp) | CCAGRCCTGCCAGGCTGCAAGGG, CCCAGRCCTGCCAGGCTGCAAGG | Bethlem myopathy |
| 794727788 | COL6A2 | NM_001849.3(COL6A2): c.812G>A (p.Gly271Asp) | AAGGRCAACATGGGTGAGCCGGG, CAAGGRCAACATGGGTGAGCCGG | Ullrich congenital muscular dystrophy, Bethlem myopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
| --- | --- | --- | --- | --- |
| 121912940 | COL6A2 | NM_001849.3(COL6A2): c.811G>A (p.Gly271Ser) | AAGRGCAACATGGGTGAGCCGGG, CAAGRGCAACATGGGTGAGCCGG | Bethlem myopathy |
| 727502827 | COL6A2 | NM_001849.3(COL6A2): c.857G>A (p.Gly286Glu) | CAGGRAGACCCGGGCATCGAAGG | Congenital muscular dystrophy |
| 727502828 | COL6A2 | NM_001849.3(COL6A2): c.874G>A (p.Gly292Ser) | GAARGCCCCATTGGATTCCCAGG | Congenital muscular dystrophy |
| 267606750 | COL6A2 | NM_001849.3(COL6A2): c.1861G>A (p.Asp621Asn) | ATCRACAGCTCCGAGAGCATTGG | Congenital muscular dystrophy, Bethlem myopathy |
| 398123646 | COL6A2 | NM_001849.3(COL6A2): c.1522-1G>A | TCCTCCARGGAGACCCCGGCAGG | Ullrich congenital muscular dystrophy, Bethlem myopathy, not provided |
| 376880198 | COL6A2 | NM_001849.3(COL6A2): c.2527C>T (p.Arg843Trp) | CCTGCTGGACGGCTCCGAGYGGC | |
| 121912942 | COL6A2 | NM_001849.3(COL6A2): c.2455C>T (p.Gln819Ter) | CCCAGACCTTCCCTGCYAAACAG, CCAGACCTTCCCTGCYAAACAGG | Myosclerosis, autosomal recessive |
| 117725825 | COL6A2 | NM_001849.3(COL6A2): c.2795C>T (p.Pro932Leu) | CCATCGTGCGCAGCCYGCCGTGGC | Congenital muscular dystrophy, Bethlem myopathy, not provided |
| 794727188 | COL6A3 | NM_004369.3(COL6A3): c.6239G>A (p.Gly2080Asp) | AACGRCACTCAAGGTTTCCAGGG, GAACGRCACTCAAGGTTTCCAGG | Bethlem myopathy |
| 398124128 | COL6A3 | NM_004369.3(COL6A3): c.6282+1G>A | AAGRTGAGGCGTGGGTGATGGGG, AAAGRTGAGGCGTGGGTGATGGG, TAAAGRTGAGGCGTGGGTGATGG | not provided |
| 121434554 | COL6A3 | NM_004369.3(COL6A3): c.1393C>T (p.Arg465Ter) | CCAACTTCAATGCCATCYGAGAC | Ullrich congenital muscular dystrophy |
| 121912829 | COL7A1 | NM_000094.3(COL7A1): c.6118G>A (p.Gly2040Ser) | CCTRGTATTCCCGGGCTCCCAGG | Generalized dominant dystrophic epidermolysis bullosa |
| 121912832 | COL7A1 | NM_000094.3(COL7A1): c.6007G>A (p.Gly2003Arg) | CGCRGGCTGAAGGGCGACCGTGG | Dominant dystrophic epidermolysis bullosa with absence of skin |
| 121912836 | COL7A1 | NM_000094.3(COL7A1): c.6127G>A (p.Gly2043Arg) | CCCRGGCTCCCAGGCAGGGCTGG, TATTCCCRGGCTCCCAGGCAGGG, GTATTCCCRGGCTCCCAGGCAGG | Generalized dominant dystrophic epidermolysis bullosa |
| 121912837 | COL7A1 | NM_000094.3(COL7A1): c.6724G>A (p.Gly2242Arg) | CAGRGGTCTCCAGGTTTGCCTGG | |
| 121912838 | COL7A1 | NM_000094.3(COL7A1): c.6091G>A (p.Gly2031Ser) | TCCRGCCTTGCCGGGGAGCCTGG | Recessive dystrophic epidermolysis bullosa |
| 121912839 | COL7A1 | NM_000094.3(COL7A1): c.6859G>A (p.Gly2287Arg) | GTCRGACCTAAAGGAGAACCTGG | Recessive dystrophic epidermolysis bullosa, Nail disorder, nonsyndromic congenital, 8 |
| 121912842 | COL7A1 | NM_000094.3(COL7A1): c.6017G>A (p.Gly2006Asp) | AAGGRCGACCGTGGAGACCCTGG | Generalized dominant dystrophic epidermolysis bullosa |
| 121912843 | COL7A1 | NM_000094.3(COL7A1): c.6044G>A (p.Gly2015Glu) | CCCTCAGGRGCCACCTGGTCTGG | Generalized dominant dystrophic epidermolysis bullosa |
| 121912844 | COL7A1 | NM_000094.3(COL7A1): c.6100G>A (p.Gly2034Arg) | GCCRGGGAGCCTGGAAAGCCTGG | Generalized dominant dystrophic epidermolysis bullosa |
| 121912846 | COL7A1 | NM_000094.3(COL7A1): c.6110G>A (p.Gly2037Glu) | CTGRAAAGCCTGGTATTCCCGGG, CCTRAAAGCCTGGTATTCCCGG | Generalized dominant dystrophic epidermolysis bullosa |
| 121912850 | COL7A1 | NM_000094.3(COL7A1): c.6227G>A (p.Gly2076Asp) | GATGRCCCTCCTGGACTCCCTGG | Generalized dominant dystrophic epidermolysis bullosa |
| 121912851 | COL7A1 | NM_000094.3(COL7A1): c.7957G>A (p.Gly2653Arg) | CCCRGGCTGGCAGGACACAAAGG | Recessive dystrophic epidermolysis bullosa |
| 387906605 | COL7A1 | NM_000094.3(COL7A1): c.4565G>A (p.Gly1522Glu) | CAGGRGCCACCAGGACCCACTGG | Transient bullous dermolysis of the newborn |
| 121912847 | COL7A1 | NM_000094.3(COL7A1): c.4888C>T (p.Arg1630Ter) | CCCAGGACCTGTTGGCCCCYGAG, CCAGGACCTGTTGGCCCCYGAGG | Stickler syndrome, type 4 |
| 121912931 | COL9A1 | NM_001851.4(COL9A1): c.883C>T (p.Arg295Ter) | CCTACCCCTCCAGGGTGACYGAG, CCCCTCCAGGGTGACYGAGGTCC, CCCTCCAGGGTGACYGAGGTCCT | |
| 387907076 | COLEC11 | NM_024027.4(COLEC11): c.610G>A (p.Gly204Ser) | CTTCATCRGCATCAACGACCTGG | Carnevale syndrome |
| 312262904 | COMP | NM_000095.2(COMP): c.2155G>A (p.Gly719Ser) | CATGCGGRGTGGCCGCCTGGGGG, CCATGCGGRGTGGCCGCCTGGGG | Pseudoachondroplastic spondyloepiphyseal dysplasia syndrome |
| 137852655 | COMP | NM_000095.2(COMP): c.2156G>A (p.Gly719Asp) | CATGCGGGRTGGCCGCCTGGGGG | Pseudoachondroplastic spondyloepiphyseal dysplasia syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918231 | COQ2 | NM_015697.7(COQ2): c.590G>A (p.Arg197His) | GCCAATCRTCCAATAGCCGCTGG | Coenzyme Q10 deficiency, primary 1 |
| 143441644 | COQ4 | NM_016035.4(COQ4): c.718C>T (p.Arg240Cys) | CCTGTACTATGAGCGGYGCTGGG | COENZYME Q10 DEFICIENCY, PRIMARY, 7 |
| 397514755 | CORO1A | NM_001193333.2(CORO1A): c.400G>A (p.Val134Met) | AGCGTRTGGGCATTGTGGCCTGG | Immunodeficiency 8 |
| 28939711 | COX15 | NM_004376.5(COX15): c.649C>T (p.Arg217Trp) | CCCATGACATCCCTYGGGTCAGT | Congenital myasthenic syndrome, acetazolamide-responsive, Cardioencephalomyopathy, fatal infantile, due to cytochrome c oxidase deficiency 2 |
| 61733458 | CP | NM_000096.3(CP): c.1652C>T (p.Thr551Ile) | CCARTGAATATATCTTTAGTGGG, CCCARTGAATATATCTTTAGTGG | Deficiency of ferroxidase, not specified |
| 386134156 | CP | NM_000096.3(CP): c.2701C>T (p.Arg901Ter) | CCCCTGATTGTTTGTYGAAGAC, CCCCTGATTGTTTGTYGAAGACC, CCCTGATTGTTTGTYGAAGACCT | Deficiency of ferroxidase |
| 114402678 | CPA6 | NM_020361.4(CPA6): c.809C>T (p.Ala270Val) | TTCTATTGRCATCCACTCCACGG | Febrile seizures, familial, 11, not provided |
| 121917866 | CPDX | NM_000097.5(CPOX): c.991C>T (p.Arg331Trp) | CCCATCGTGGAGAAYGGCGGGGC | Coproporphyria |
| 121917871 | CPDX | NM_000097.5(CPOX): c.85C>T (p.Gln29Ter) | CCCCGCGCCTGGTCCYAGTGCGG, CCCGCGCCTGGTCCYAGTGCGGC | Coproporphyria |
| 28936374 | CPT | NM_001876.3(CPT1A): c.2126G>A (p.Gly709Glu) | CAGCGRAGGGGGCTTTGGACCGG | Carnitine palmitoyltransferase I deficiency |
| 80356780 | CPT | NM_001876.3(CPT1A): c.2129G>A (p.Gly710Glu) | CAGCGGAGRGGGCTTTGGACCGG | Carnitine palmitoyltransferase I deficiency |
| 80356794 | CPT1A | NM_001876.3(CPT1A): c.1425G>A (p.Trp475Ter) | CTGRGCAGATGCGCCGATCGTGG | Carnitine palmitoyltransferase I deficiency |
| 80356775 | CPT1A | NM_001876.3(CPT1A): c.367C>T (p.Arg123Cys) | CCCTCATCGTCACCATGYGCTAC, CCTCATCGTCACCATGYGCTACT | Carnitine palmitoyltransferase I deficiency, not provided |
| 80356779 | CPT1A | NM_001876.3(CPT1A): c.1436C>T (p.Pro479Leu) | CCTGGGCAGATGCGCYGATCGTG | Carnitine palmitoyltransferase I deficiency, not provided |
| 727503887 | CPT2 | NM_000098.2(CPT2): c.886C>T (p.Arg296Ter) | CCTGACCAGTGAGAACYGAGACA | CARNITINE PALMITOYLTRANSFERASE II DEFICIENCY, LATE-ONSET, Carnitine palmitoyltransferase II deficiency, infantile |
| 74315296 | CPT2 | NM_000098.2(CPT2): c.1507C>T (p.Arg503Cys) | CCGCACTGAGACCATCYGCCCGG | |
| 28939720 | CRB1 | NM_201253.2(CRB1): c.2234C>T (p.Thr745Met) | CCATGTTTGTCCGAAYGCTTCAA | Retinitis pigmentosa 12, not provided |
| 730880377 | CRB2 | NM_173689.6(CRB2): c.1897C>T (p.Arg633Trp) | CCGTTGCGACTGTGCCYGGCCCC | Ventriculomegaly with cystic kidney disease |
| 587783476 | CREBBP | NM_004380.2(CREBBP): c.286C>T (p.Gln96Ter) | CCAGCAGCCCCGTGYAGCAGGGC | Rubinstein-Taybi syndrome |
| 587783475 | CREBBP | NM_004380.2(CREBBP): c.2791C>T (p.Gln931Ter) | CCAGGTGACCCCGCAGCCTYAAA | Rubinstein-Taybi syndrome |
| 587783479 | CREBBP | NM_004380.2(CREBBP): c.3310C>T (p.Gln1104Ter) | CCTAGAAGCACTGTATCGAYAGG | Rubinstein-Taybi syndrome |
| 587783490 | CREBBP | NM_004380.2(CREBBP): c.4078C>T (p.Arg1360Ter) | CCGGGGAGGTTTTTGTCYGAGTG | Rubinstein-Taybi syndrome |
| 587783509 | CREBBP | NM_004380.2(CREBBP): c.598C>T (p.Gln200Ter) | CCATAGCTTAATTAATYAGGCTT | Rubinstein-Taybi syndrome |
| 587783510 | CREBBP | NM_004380.2(CREBBP): c.6088C>T (p.Gln2030Ter) | CCCCTTCCCCAGCAGYAGCCCAT, CCCTTCCCCAGCAGYAGCCCATG | Rubinstein-Taybi syndrome |
| 137853932 | CRLF1 | NM_004750.4(CRLF1): c.397+1G>A | TTGGCCRTAAGTTGGCACCCAGG | Cold-induced sweating syndrome 1 |
| 137853926 | CRLF1 | NM_004750.4(CRLF1): c.538C>T (p.Gln180Ter) | CCCCGCAGGTGGTATGGCYAGGA, CCCGCAGGTGGTATGGCYAGGAC, CCGCAGGTGGTATGGCYAGGACA | Cold-induced sweating syndrome 1 |
| 137853930 | CRLF1 | NM_004750.4(CRLF1): c.413C>T (p.Pro138Leu) | CCAGTGCCCCCAGAGAAACYCGT | Cold-induced sweating syndrome 1 |
| 72659357 | CRTAP | NM_006371.4(CRTAP): c.3G>A (p.MetIle) | GATRGAGCCGGGGCGCCGGGGGG, CGATRGAGCCGGGGCGCCGGGGG, GCGATRGAGCCGGGGCGCCGGGG, CGCGATRGAGCCGGGGCGCCGGG, GCGCGATRGAGCCGGGGCGCCGG | Osteogenesis imperfecta type 7 |
| 104894672 | CRX | NM_000554.4(CRX): c.121C>T (p.Arg41Trp) | CCCAGGAAGCAGCGGYGGGAG, CCCCAGGAAGCAGCGGYGGGAGC, CCCAGGAAGCAGCGGYGGGAGCG, CCAGGAAGCAGCGGYGGGAGCGC | Cone-rod dystrophy 2, not provided |
| 104894673 | CRX | NM_000554.4(CRX): c.268C>T (p.Arg90Trp) | CCAGGTTTGGTTCAAGAACYGGA | Leber congenital amaurosis 7, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 74315440 | CRYAA | NM_000394.3(CRYAA): c.27G>A (p.Trp9Ter) | CCTGRTTCAAGCGCACCCTGGGG, CCCTGRTTCAAGCGCACCCTGGG, CCCCTGRTTCAAGCGCACCCTGG | |
| 397515623 | CRYAA | NM_000394.3(CRYAA): c.160C>T (p.Arg54Cys) | CCGCCAGTCCCTCTTCYGCACCG | Cataract, autosomal dominant |
| 397515624 | CRYAA | NM_000394.3(CRYAA): c.34C>T (p.Arg12Cys) | CCAGCACCCCTGGTTCAAGYGCA | Cataract, autosomal dominant, multiple types, with microcornea |
| 74315439 | CRYAA | NM_000394.3(CRYAA): c.346C>T (p.Arg116Cys) | CCCGTGAGTTCCACYGCCGCTAC | Cataract, autosomal dominant |
| 74315441 | CRYAA | NM_000394.3(CRYAA): c.145C>T (p.Arg49Cys) | CCATCAGCCCCTACTACYGCCAG | Cataract, autosomal dominant |
| 387907338 | CRYAB | NM_001885.2(CRYAB): c.166C>T (p.Arg56Trp) | CCACCCTCCTTCCTGYGGGCACC | Posterior polar cataract type 2 |
| 397515555 | CSF1R | NM_005211.3(CSF1R): c.1958G>A (p.Cys653Tyr) | GCCRTACCCATGGAGGTAAGGG, AGCCRTACCCATGGAGGTAAGG | Hereditary diffuse leukoencephalopathy with spheroids |
| 690016564 | CSF1R | NM_005211.3(CSF1R): c.2350G>A (p.Val784Met) | CGTAACRTGCTGTTGACCAATGG | Hereditary diffuse leukoencephalopathy with spheroids |
| 281860268 | CSF1R | NM_005211.3(CSF1R): c.1766G>A (p.Gly589Glu) | CCCTCGRAGCTGGAGCCTTTGGG, ACCCTCGRAGCTGGAGCCTTTGG | Hereditary diffuse leukoencephalopathy with spheroids |
| 397515556 | CSF1R | NM_005211.3(CSF1R): c.2329C>T (p.Arg777Trp) | CCCTCAGTGCATCCACYGGGACG, CCTCAGTGCATCCACYGGGACGT | Hereditary diffuse leukoencephalopathy with spheroids |
| 690016562 | CSF1R | NM_005211.3:c.2467C>T | CCTGTGAAGTGGATGGYCCCAGA | Hereditary diffuse leukoencephalopathy with spheroids |
| 606231473 | CSF3R | NM_000760.3(CSF3R): c.922C>T (p.Arg308Cys) | CCTACACCCTGCAGATAYGCTGC | Severe congenital neutropenia |
| 796065343 | CSF3R | NM_156039.3(CSF3R): c.1853C>T (p.Thr618Ile) | CCTCACCCTGATGAYCTTGACCC | Early T cell progenitor acute lymphoblastic leukemia |
| 1064039 | CST3 | NM_000099.3(CST3): c.73G>A (p.Ala25Thr) | CCCGCGRCCGGCTCCAGTCCCGG | Age-related macular degeneration 11 |
| 545986367 | CSTB | NM_000100.3(CSTB): c.136C>T (p.Gln46Ter) | CACCTRGCTCTTGAATGACACGG | not provided |
| 387907080 | CTC1 | NM_025099.5(CTC1): c.775G>A (p.Val259Met) | CCACRTGTCCATCATCGTGCAGG | Cerebroretinal microangiopathy with calcifications and cysts |
| 121913413 | CTNNB1 | NM_001904.3(CTNNB1): c.122C>T (p.Thr41Ile) | CCATTCTGGTGCCACTAYCACAG | Pilomatrixoma |
| 35086888 | CTNS | NM_001031681.2(CTNS): c.124G>A (p.Val42Ile) | CCGCAGGGTGAGGCTGAYGTTGG | Cystinosis, atypical nephropathic |
| 515726209 | CTRC | NM_007272.2(CTRC): c.217G>A (p.Ala73Thr) | TCACTGCCRCCCACTGCATCAGG | Hereditary pancreatitis |
| 121909293 | CTRC | NM_007272.2(CTRC): c.760C>T (p.Arg254Trp) | CCGGTAGTCTACACCYGGGTGTC | Hereditary pancreatitis, Pancreatitis, chronic, susceptibility to |
| 104894209 | CTSC | NM_001814.4(CTSC): c.856C>T (p.Gln286Ter) | CCCCAATCCTAAGCCCYAGGAG, CCCAATCCTAAGCCCYAGGAGG, CCAATCCTAAGCCCYAGGAGGT | Papillon-Lenxc3\xa8vre syndrome |
| 587779409 | CTSD | NM_001909.4(CTSD): c.470C>T (p.Ser157Leu) | CCAGGACACTGTGTYGGTGAGTC | Ceroid lipofuscinosis neuronal 10 |
| 3732378 | CX3CR1 | NM_001171174.1(CX3CR1): c.935C>T (p.Thr312Met) | AACCRTCTCAGTCACACTGAGGG, CAACCRTCTCAGTCACACTGAGG | Age-related macular degeneration 12 |
| 3732379 | CX3CR1 | NM_001171174.1(CX3CR1): c.841G>A (p.Val281Ile) | CCAGGAAAATCATAAYGTTGTAG | Age-related macular degeneration 12 |
| 104893624 | CXCR4 | NM_003467.2(CXCR4): c.1000C>T (p.Arg334Ter) | CCTCTCCAAAGGAAAGYGAGGTG | Warts, hypogammaglobulinemia, infections, and myelokathexis |
| 121965009 | CYB5R3 | NM_000398.6(CYB5R3): c.316G>A (p.Val106Met) | CTTCRTGGACCTGGTCATCAAGG | METHEMOGLOBINEMIA, TYPE I |
| 61732609 | CYB5R3 | NM_000398.6(CYB5R3): c.478C>T (p.Arg160Ter) | GTCRGATGGCGAACTTCCCTGGG, GGTCRGATGGCGAACTTCCCTGG | Methemoglobinemia type 2 |
| 121965014 | CYB5R3 | NM_000398.6(CYB5R3): c.229C>T (p.Gln77Ter) | CCCGTTCTGTCCTGCAGGCYAGC, CCGTTCTGTCCTGCAGGCYAGCA | Methemoglobinemia type 2 |
| 200872504 | CYB5R3 | NM_000398.6(CYB5R3): c.463+8G>C | CCAAGGGATTCCGACCYGAATCA | Methemoglobinemia type 2 |
| 137854590 | CYBB | NM_000397.3(CYBB): c.466G>A (p.Ala156Thr) | TTTTRCTCGAAAGAGAATAAAGG | Granulomatous disease, chronic, X-linked, variant, not provided |
| 104894139 | CYP17A1 | NM_000102.3(CYP17A1): c.1073G>A (p.Arg358Gln) | TCCRAGAGGTGCTTCGCCTCAGG | Isolated 17,20-lyase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894153 | CYP17A1 | NM_000102.3(CYP17A1): c.287G>A (p.Arg96Gln) | GGGCRGCCTCAAATGGTAAGTGG | Complete combined 17-alpha-hydroxylase/17,20-lyase deficiency |
| 104894154 | CYP17A1 | NM_000102.3(CYP17A1): c.374G>A (p.Arg125Gln) | GCTGCATCRAAGGCTGGCGATGG | Complete combined 17-alpha-hydroxylase/17,20-lyase deficiency |
| 104894155 | CYP17A1 | NM_000102.3(CYP17A1): c.1247G>A (p.Arg416His) | AGCRTTTCTTGAATCCAGCGGGG, GAGCRTTTCTTGAATCCAGCGGG, AGAGCRTTTCTTGAATCCAGCGG | Complete combined 17-alpha-hydroxylase/17,20-lyase deficiency |
| 104894142 | CYP17A1 | cM_000102.3(CYP17A1): c.1084C>T (p.Arg362Cys) | CCATCCGAGAGGTGCTTYGCCTC | Complete combined 17-alpha-hydroxylase/17,20-lyase deficiency |
| 104894145 | CYP17A1 | NM_000102.3(CYP17A1): c.1283C>T (p.Pro428Leu) | CCCAGCTCATCTCACYGTCAGTA, CCAGCTCATCTCACYGTCAGTAA | Complete combined 17-alpha-hydroxylase/17,20-lyase deficiency |
| 104894149 | CYP17A1 | NM_000102.3(CYP17A1): c.1039C>T (p.Arg347Cys) | CCAACTATCAGTGACYGTAACCG | Combined partial 17-alpha-hydroxylase/17,20-lyase deficiency |
| 28936700 | CYP1B1 | NM_000104.3(CYP1B1): c.182G>A (p.Gly61Glu) | ATCGRAAACGCGGCGGCGGTGGG, GATCGRAAACGCGGCGGCGGTGG, ACTGATCGRAAACGCGGCGGCGG | Glaucoma, congenital |
| 201824781 | CYP1B1 | NM_000104.3(CYP1B1): c.155C>T (p.Pro52Leu) | ACGGGCCCRGGGGCGCGGACCGG | Glaucoma, primary open angle, juvenile-onset |
| 79204362 | CYP1B1 | NM_000104.3(CYP1B1): c.1103G>A (p.Arg368His) | CCCATACAAGGCAGAYGGTCCCT, CCATACAAGGCAGAYGGTCCCTC | Glaucoma, congenital, Coloboma, not provided |
| 151344503 | CYP21A2 | NM_000500.7(CYP21A2): c.1217G>A (p.Trp406Ter) | GTTCTRGCCTGGTATGTGGGGGG, AGTTCTRGCCTGGTATGTGGGGG, GAGTTCTRGCCTGGTATGTGGGG, TGAGTTCTRGCCTGGTATGTGGG | 21-hydroxylase deficiency |
| 7769409 | CYP21A2 | NM_000500.7(CYP21A2): c.1069C>T (p.Arg357Trp) | CCGAGGTGCTGCGCCTGYGGCCC | 21-hydroxylase deficiency |
| 6445 | CYP21A2 | NM_000500.7(CYP21A2): c.1360C>T (p.Pro454Ser) | CCTTCACGCTGCTGYCCTCCGGG | 21-hydroxylase deficiency |
| 9378251 | CYP21A2 | NM_000500.7(CYP21A2): c.92C>T (p.Pro31Leu) | CCGGAGCCTCCACCTCCYGCCTC | 21-hydroxylase deficiency |
| 7755898 | CYP21A2 | NM_000500.7(CYP21A2): c.955C>T (p.Gln319Ter) | CCAGATTCAGCAGCGACTGYAGG | 21-hydroxylase deficiency |
| 387907324 | CYP24A1 | NM_000782.4(CYP24A1): c.964G>A (p.Glu322Lys) | CACARAGCTCCAGCTGGCTGCGG | Idiopathic hypercalcemia of infancy |
| 121908097 | CYP27A1 | NM_000784.3(CYP27A1): c.1421G>A (p.Arg474Gln) | TCCRGGCCTGCCTGGGCCGCAGG | Cholestanol storage disease |
| 121908099 | CYP27A1 | NM_000784.3(CYP27A1): c.1214G>A (p.Arg405Gln) | AAACTCCCRGATCATAGAAAAGG | Cholestanol storage disease |
| 587778797 | CYP27A1 | NM_000784.3(CYP27A1): c.446+1G>A | CACRTGAGCTGGGGCCTGAAGGG, CCACRTGAGCTGGGGCCTGAAGG | Cholestanol storage disease |
| 376230356 | CYP27A1 | NM_000784.3(CYP27A1): c.380G>A (p.Arg127Gln) | TACRGAACGACATGGAGCTATGG | Cholestanol storage disease |
| 72551314 | CYP27A1 | NM_000784.3(CYP27A1): c.475C>T (p.Gln159Ter) | CCACTGGTACCAGCTGCGCYAGG | Cholestanol storage disease |
| 72551316 | CYP27A1 | NM_000784.3(CYP27A1): c.745C>T (p.Gln249Ter) | CCATCGGGTTAATGTTCYAGAAC | Cholestanol storage disease |
| 121908098 | CYP27A1 | NM_000784.3(CYP27A1): c.1420C>T (p.Arg474Trp) | CCCTTTGGCTATGGGGTCYGGGC, CCTTTGGCTATGGGGTCYGGGCC | Cholestanol storage disease |
| 587778787 | CYP27A1 | NM_000784.3(CYP27A1): c.1402C>T (p.Pro468Ser) | CCCATTTGGCTCTGTGYCCTTTG, CCATTTGGCTCTGTGYCCTTTGG | Cholestanol storage disease |
| 28934604 | CYP27B1 | NM_000785.3(CYP27B1): c.320G>A (p.Arg107His) | AGCRCTGCAGCTTCTCGCCCTGG | Vitamin D-dependent rickets, type 1 |
| 118204008 | CYP27B1 | NM_000785.3(CYP27B1): c.1226C>T (p.Thr409Ile) | CCAGACGCTGGTCAYTCTGTGTC | Vitamin D-dependent rickets, type 1 |
| 118204011 | CYP27B1 | NM_000785.3(CYP27B1): c.1027C>T (p.Leu343Phe) | CCCCGAAGTCCAGACAGCAYTCC, CCCGAAGTCCAGACAGCAYTCCA, CCGAAGTCCAGACAGCAYTCCAC | Vitamin D-dependent rickets, type 1 |
| 199476187 | CYP4V2 | NM_207352.3(CYP4V2): c.283G>A (p.Gly95Arg) | GGTCRGGCCAGTGCCCATGGTGG, CTGGGTCRGGCCAGTGCCCATGG | Bietti crystalline corneoretinal dystrophy |
| 199476198 | CYP4V2 | NM_207352.3(CYP4V2): c.1020G>A (p.Trp340Ter) | AACTGRTCCTTATACCTGTTGGG, AAACTGRTCCTTATACCTGTTGG | Bietti crystalline corneoretinal dystrophy |
| 119103284 | CYP4V2 | NM_207352.3(CYP4V2): c.1523G>A (p.Arg508His) | TTCRTCCAAGTAATGGCATCTGG | Bietti crystalline corneoretinal dystrophy |
| 199476202 | CYP4V2 | NM_207352.3(CYP4V2): c.1187C>T (p.Pro396Leu) | CCTTTTCCTTCTGTTCYTTTAT | Bietti crystalline corneoretinal dystrophy |
| 121908611 | CYP7B1 | NM_004820.3(CYP7B1): c.1250G>A (p.Arg417His) | TATGATCRTTTTATAGAAGATGG | Spastic paraplegia 5A |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72554620 | CYP7B1 | NM_004820.3(CYP7B1): c.1162C>T (p.Arg388Ter) | CCGGGGACTACTGTGTGYGAAAG | Spastic paraplegia 5A, Bile acid synthesis defect, congenital, 3 |
| 193922955 | DAG1 | NM_001165928.3(DAG1): c.575C>T (p.Thr192Met) | CCTGTGACTGTTTTGAYGGTGAT | Limb-girdle muscular dystrophy-dystroglycanopathy, type C9, not provided |
| 121918212 | DARS2 | NM_018122.4(DARS2): c.1837C>T (p.Leu613Phe) | CCTTCCGGGGACATGACYTCATG | Leukoencephalopathy with Brainstem and Spinal Cord Involvement and Lactate Elevation |
| 200670286 | DARS2 | NM_018122.4(DARS2): c.1825C>T (p.Arg609Trp) | CCTTCCCAAAGTCCTTCYGGGGA | Leukoencephalopathy with Brainstem and Spinal Cord Involvement and Lactate Elevation |
| 267606760 | DBH | NM_000787.3(DBH): c.301G>A (p.Val101Met) | CTCRTGGTGCTCTGGACCGATGG | Dopamine beta hydroxylase deficiency |
| 185492864 | DBT | NM_001918.3(DBT): c.901C>T (p.Arg301Cys) | ATTCCACRAGCAAATGCAATGGG, AATTCCACRAGCAAATGCAATGG | Maple syrup urine disease, not provided |
| 72466485 | DCTN1 | NM_004082.4(DCTN1): c.211G>A (p.Gly71Arg) | ATGATRGAACTGTTCAAGGCAGG | Perry syndrome |
| 104894779 | DCX | NM_178152.2(DCX): c.184G>A (p.Asp62Asn) | ATGGGRACCGCTACTTCAAGGGG, AATGGGRACCGCTACTTCAAGGG, CAATGGGRACCGCTACTTCAAGG | Lissencephaly, X-linked, Subcortical laminar heterotopia, X-linked |
| 587783544 | DCX | NM_178151.2(DCX): c.364G>A (p.Gly122Arg) | AGGAARGTAATTTAAATAGTGGG, GAGGAARGTAATTTAAATAGTGG | Heterotopia |
| 587783527 | DCX | NM_178151.2(DCX): c.182G>A (p.Gly61Glu) | ATGRGGACCGCTACTTCAAGGGG, AATGRGGACCGCTACTTCAAGGG, CAATGRGGACCGCTACTTCAAGG | Heterotopia |
| 587783589 | DCX | NM_178151.2(DCX): c.809-1G>A | CCARAATGCCGAGTCATGAAGGG, CCCARAATGCCGAGTCATGAAGG | Heterotopia |
| 104894780 | DCX | NM_178151.2(DCX): c.574C>T (p.Arg192Trp) | CCGCAGTGGGGTGAAGCCTYGGA | Lissencephaly, X-linked, Subcortical laminar heterotopia, X-linked, Heterotopia |
| 587783519 | DCX | NM_178151.2(DCX): c.115C>T (p.Arg39Ter) | CCCACTGTAGCTTCTACYGAACC, CCACTGTAGCTTCTACYGAACCA | Heterotopia |
| 587783522 | DCX | NM_178151.2(DCX): c.130C>T (p.Gln44Ter) | CCGAACCAGAACCTTGYAGGCAC | Heterotopia |
| 587783535 | DCX | NM_178151.2(DCX): c.232C>T (p.Arg78Cys) | CCTCTGACCGTTTTYGCAGCTTT | Heterotopia |
| 587783541 | DCX | NM_178151.2(DCX): c.304C>T (p.Arg102Cys) | CCTGCCTCAGGGAGTGYGTTACA | Heterotopia |
| 587783554 | DCX | NM_178151.2(DCX): c.478C>T (p.Gln160Ter) | CCAATATGAAAGCCCCCYAGTCC | Heterotopia |
| 587783590 | DCX | NM_178151.2(DCX): c.814C>T (p.Arg272Ter) | CCTTTTGCCCCAGAATGCYGAGT | Heterotopia |
| 587783592 | DCX | NM_178151.2(DCX): c.907C>T (p.Arg303Ter) | CCCTGGTCCTATGCGCYGAAGCA, CCTGGTCCTATGCGCYGAAGCAA | Heterotopia |
| 121434641 | DDB2 | NM_000107.2(DDB2): c.937C>T (p.Arg313Ter) | CCAGAAGAGCGAGATCYGAGTTT | Xeroderma pigmentosum, group E |
| 137853208 | DDC | NM_001082971.1(DDC): c.749C>T (p.Ser250Phe) | CCACAACATGCTGCTYCTTTGAC | Deficiency of aromatic-L-amino-acid decarboxylase |
| 121964863 | DDR2 | NM_001014796.1(DDR2): c.2254C>T (p.Arg752Cys) | CCGGGCAGTGCTCCCTATCYGCT | Spondylometaepiphyseal dysplasia short limb-hand type |
| 796052231 | DDX3X | NM_001356.4(DDX3X): c.1126C>T (p.Arg376Cys) | CCTCCAAAGGGTGTCYGCCACAC | not provided, MENTAL RETARDATION, X-LINKED 102 |
| 796052234 | DDX3X | NM_001356.4(DDX3X): c.1462C>T (p.Arg488Cys) | CCCTTCACCAGTTCYGCTCAGGA | not provided |
| 796052236 | DDX3X | NM_001356.4(DDX3X): c.1490C>T (p.Ala497Val) | CCCAATTTAGTGGYTACAGCAG | not provided |
| 587777408 | DEAF1 | NM_021008.3(DEAF1): c.670C>T (p.Arg224Trp) | CCCCRGCCGCCTGCAAGGAAGGG, TCCCCRGCCGCCTGCAAGGAAGG | Mental retardation, autosomal dominant 24 |
| 587777458 | DEPDC5 | NM_001242896.1(DEPDC5): c.3259C>T (p.Arg1087Ter) | CCTACATGGACAGCCCAYGAAAG | Epilepsy, partial, with variable foci |
| 748323823 | DES | NM_001927.3(DES): c.1371+1G>A | GGGAGRTAAGTGGTCTGTCTGGG, GGGGAGRTAAGTGGTCTGTCTGG | not provided |
| 57694264 | DES | NM_001927.3(DES): c.1201G>A (p.Glu401Lys) | ATGTGRAGATTGCCACCTACCGG | not provided |
| 61726467 | DES | NM_001927.3(DES): c.1237G>A (p.Glu413Lys) | GGGAGAGRAGAGCCGGTGAGGGG, AGGGAGAGRAGAGCCGGTGAGGG | not provided |
| 62635763 | DES | NM_001927.3(DES): c.1255C>T (p.Pro419Ser) | CCCTTTTAGGATCAATCTCYCCA, CCTTTTAGGATCAATCTCYCCAT | Myofibrillar myopathy 1, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 62636495 | DES | NM_001927.3(DES): c.38C>T (p.Ser13Phe) | CCAGCCAGCGCGTGTCCTYCTAC, CCAGCGCGTGTCCTYCTACCGCC | Dilated cardiomyopathy 11, Myofibrillar myopathy 1, not provided |
| 397517255 | DFNB31 | NM_015404.3(DFNB31): c.1267C>T (p.Arg423Ter) | CCTGGGGAACCAGACAYGAGTGC | Usher syndrome, type 2D |
| 779760634 | DFNB31 | NM_015404.3(DFNB31): c.1417-1G>A | CCTCAGAGAGGAGTGAGAAYTGG | Deafness, autosomal recessive 31 |
| 137852839 | DFNB31 | NM_015404.3(DFNB31): c.2332C>T (p.Arg778Ter) | CCAGCGCCCCAGGCYGAGGAAGG | Deafness, autosomal recessive 31 |
| 398123008 | DGKE | NM_003647.2(DGKE): c.127C>T (p.Gln43Ter) | CCTTCTGGTGTAGCCTCYAGCGG | Nephrotic syndrome, type 7 |
| 104893631 | DGUOK | NM_080916.2(DGUOK): c.425G>A (p.Arg142Lys) | AGARGTCTGTGTACAGTGACAGG | Mitochondrial DAN-depletion syndrome 3, hepatocerebral |
| 121909764 | DHCR7 | NM_001360.2(DHCR7): c.730G>A (p.Gly244Arg) | GGCGCCCCRGGATCGTCGCCTGG | Smith-Lemli-Opitz syndrome |
| 80338857 | DHCR7 | NM_001360.2(DHCR7): c.725G>A (p.Arg242His) | GGCRCCCCGGGATCGTCGCCTGG | Smith-Lemli-Opitz syndrome |
| 398123607 | DHCR7 | NM_001360.2(DHCR7): c.841G>A (p.Val281Met) | TCTACRTGATTGACTTCTTCTGG | Smith-Lemli-Opitz syndrome, not provided |
| 80338853 | DHCR7 | NM_001360.2(DHCR7): c.278C>T (p.Thr93Met) | CCAAGACTCCACCTATAAYGAGG | Smith-Lemli-Opitz syndrome, not provided |
| 104886035 | DHCR7 | NM_001360.2(DHCR7):1 c.151C>T (p.Pro51Ser) | CCTACTGCTGTTCGCCYCCTTCA | Smith-Lemli-Opitz syndrome, not provided |
| 267606766 | DHODH | NM_001361.4(DHODH): c.454G>A (p.Gly152Arg) | CAGTCACRGGCTTTCAGTGGTGG | Miller syndrome |
| 201230446 | DHODH | NM_001361.4(DHODH): c.403C>T (p.Arg135Cys) | CCCTAGACCCAGAGTCTTCYGCC, CCCTAGACCCAGAGTCTTCYGCT | Miller syndrome |
| 199422247 | DKC1 | NM_001363.4(DKC1): c.911G>A (p.Ser304Asn) | AAGACARTGCAGTAAGTTCCGGG, AAAGACARTGCAGTAAGTTCCGG | Dyskeratosis congenita X-linked |
| 121912289 | DKC1 | NM_001363.4(DKC1): c.1226C>T (p.Pro409Leu) | CCCACAGACAGCACACYTGCCAC, CCACAGACAGCACACYTGCCACC | Dyskeratosis congenita X-linked |
| 121964992 | DLD | NM_000108.4(DLD): c.1123G>A (p.Glu375Lys) | TGTGTTAAGGAATGGCTGGTGG | Maple syrup urine disease, type 3, not provided |
| 796065346 | DLL4 | NM_019074.3(DLL4): c.1169G>A (p.Cys390Tyr) | GAATRTCCCCCAACTTCACCGG | Adams-Oliver syndrome, ADAMS-OLIVER SYNDROME 6 |
| 398122853 | DMD | NM_004006.2(DMD): c.9G>A (p.Trp3Ter) | GCTTTGRTGGGAAGAAGTAGAGG | Duchenne muscular dystrophy, Becker muscular dystrophy, Dilated cardiomyopathy 3B, not provided |
| 398123936 | DMD | NM_004006.2(DMD): c.336G>A (p.Trp112Ter) | TTTGRAATATAATCCTCCACTGG | Duchenne muscular dystrophy, Becker muscular dystrophy, Dilated cardiomyopathy 3B |
| 398123939 | DMD | NM_004006.2(DMD): c.3433-1G>A | GAARGTCTATGCCAGAAAGGAGG, GTGGAARGTCTATGCCAGAAAGG | Dilated cardiomyopathy 3B |
| 398124032 | DMD | NM_004006.2(DMD): c.649+1G>A | CCTGAAGRTTGGTAAATTTCTGG | Duchenne muscular dystrophy, Becker muscular dystrophy, Dilated cardiomyopathy 3B |
| 398124076 | DMD | NM_004006.2(DMD): c.8668G>A (p.Glu2890Lys) | AGCCCAGARGTAATTGAATGTGG | Dilated cardiomyopathy 3B |
| 398124096 | DMD | NM_004006.2(DMD): c.9564-1G>A | ATAATARGGGACGAACAGGGAGG | Duchenne muscular dystrophy, Becker muscular dystrophy, Dilated cardiomyopathy 3B |
| 794727499 | DMD | NM_004006.2(DMD): c.133C>T (p.Gln45Ter) | CCTCTTCAGTGACCTAYAGGATG | Duchenne muscular dystrophy, Becker muscular dystrophy |
| 128626233 | DMD | NM_004006.2(DMD): c.178C>T (p.Gln60Ter) | CCTCGAAGGCCTGACAGGGYAAA | Duchenne muscular dystrophy |
| 128626238 | DMD | NM_000109.3(DMD): c.700C>T (p.Gln234Ter) | CCAAGTTTTGCCTCAAYAAGTGA | Duchenne muscular dystrophy |
| 128626245 | DMD | NM_004006.2(DMD): c.3121C>T (p.Gln1041Ter) | CCAGCTGGTTGAGCATTGTYAAA | Duchenne muscular dystrophy, Dilated cardiomyopathy 3B |
| 398123865 | DMD | NM_004006.2(DMD): c.1615C>T (p.Arg539Ter) | CCAGGTATTGGGAGATYGATGGG | Duchenne muscular dystrophy, Becker muscular dystrophy, Dilated cardiomyopathy 3B |
| 398123903 | DMD | NM_004006.2(DMD): c.2650C>T (p.Gln884Ter) | CCGGCTATCAGATCTTYAACCTC | Duchenne muscular dystrophy, Becker muscular dystrophy, Dilated cardiomyopathy 3B |
| 398123912 | DMD | NM_004006.2(DMD): c.2866C>T (p.Gln956Ter) | CCATCAGGACATGGGTCYAGCAG | Dilated cardiomyopathy 3B |
| 398123954 | DMD | NM_004006.2(DMD): c.4405C>T (p.Gln1469Ter) | CCAGCCAATTTGAGYAGCGTCT | Dilated cardiomyopathy 3B |
| 398123990 | DMD | NM_004006.2(DMD): c.5353C>T (p.Gln1785Ter) | CCTTTGAAGGAATTGGAGYAGTT | Dilated cardiomyopathy 3B |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123999 | DMD | NM_004006.2(DMD): c.583C>T (p.Arg195Ter) | CCAGCAGTCAGCCACACAAYGAC | Duchenne muscular dystrophy, Becker muscular dystrophy, Dilated cardiomyopathy 3B |
| 398124058 | DMD | NM_004006.2(DMD): c.7894C>T (p.Gln2632Ter) | CCAAAGACCTCCGCYAGTGGCAG | Duchenne muscular dystrophy, Becker muscular dystrophy, Dilated cardiomyopathy 3B |
| 398124099 | DMD | NM_004006.2(DMD): c.961-5831C>T | CCTTTGTGACCTTTGGYAAGTCA | Dilated cardiomyopathy 3B |
| 368260932 | DNAH11 | (NM_001277115.1(DNAH11): c.8698C>T (p.Arg2900Ter) | CCAATTTGTACATCYGAACTGGA | Ciliary dyskinesia, primary, 7 |
| 567050969 | DNAH8 | NM_001206927.1(DNAH8): c.2419C>T (p.Arg807Ter) | CCACGCTTTTTGTGYGACATCCA | Kartagener syndrome, not provided |
| 730882139 | DNAJB2 | NM_001039550.1(DNAJB2): c.229+1G>A | GACAGRTAGGTGGAGTGGTGAGG | Charcot-Marie-Tooth disease, Spinal muscular atrophy, distal, autosomal recessive, 5 |
| 398122405 | DNAJC6 | NM_001256865.1(DNAJC6): c.2200C>T (p.Gln734Ter) | CCCCACTCCTCTCCCYAGAACCG, CCCACTCCTCTCCCYAGAACCGA | Parkinson disease 19, juvenile-onset |
| 121909089 | DNM2 | NM_001005360.2(DNM2): c.1106G>A (p.Arg369Gln) | CGAGCRGTTCCCATTTGAGCTGG | Myopathy, centronuclear, 1, Myopathy, centronuclear |
| 796065342 | DNMT3A | NM_175629.2(DNMT3A): c.1204C>T (p.Gln402Ter) | CCAAGGCCGTGGAGGTGYAGAAC | Early T cell progenitor acute lymphoblastic leukemia |
| 121908943 | DNMT3B | NM_006892.3(DNMT3B): c.1807G>A (p.Ala603Thr) | CGTCRCTTCTGAAGTGTGTGAGG | Centromeric instability of chromosomes 1,9 and 16 and immunodeficiency |
| 547940069 | DNMT3B | NM_175850.2(DNMT3B): c.2397-11G>A | TCCRGTACCCCAGGATCTTTGG | Centromeric instability of chromosomes 1,9 and 16 and immunodeficiency |
| 780318765 | DOCK2 | NM_004946.2(DOCK2): c.3310C>T (p.Arg1104Trp) | CCCTGAGGCTGAGCTCYGGAAAG, CCTGAGGCTGAGCTCYGGAAAGC | IMMUNODEFICIENCY 40 |
| 587777484 | DOCK7 | NM_033407.3(DOCK7): c.3616C>T (p.Arg1206Ter) | CCACTCRAGCCTTTATCTGAGGG, GCCACTCRAGCCTTTATCTGAGG | Epileptic encephalopathy, early infantile, 23 |
| 397515322 | DPAGT1 | NM_001382.3(DPAGT1): c.161+5G>A | TGARCAGCGGCACACGGGTCCGG, AGATGTGARCAGCGGCACACGGG | Congenital disorder of glycosylation type 1J |
| 397515640 | DSG1 | NM_001942.3(DSG1): c.601C>T (p.Gln201Ter) | CCTTCAAGATTATAAGAYAAGAA | Keratosis palmplantaris striata 1 |
| 751012696 | DSG2 | NM_001943.3(DSG2): c.889G>A (p.Asp297Asn) | GTGTTCRATGCAGATGAAATAGG | Cardiomyopathy |
| 121913008 | DSG2 | NM_001943.3(DSG2): c.137G>A (p.Arg46Gln) | TAGTGCRGCAAAAGCGCGCCTGG | Arrhythmogenic right ventricular cardiomyopathy, type 10, Cardiomyopathy |
| 121913013 | DSG2 | NM_001943.3(DSG2): c.166G>A (p.Val56Met) | GCCCCCRTGGCTCTTCGGGAGGG, CGCCCCRTGGCTCTTCGGGAGG | Arrhythmogenic right ventricular cardiomyopathy, Arrhythmogenic right ventricular cardiomyopathy, type 10, Catecholaminergic polymorphic ventricular tachycardia, Dilated cardiomyopathy 1BB, Primary familial hypertrophic cardiomyopathy, Cardiomyopathy, not specified |
| 201564919 | DSG2 | NM_001943.3(DSG2): c.1912G>A (p.Gly638Arg) | CATTGCRGAAAGGGCGCCAAAGG | Arrhythmogenic right ventricular cardiomyopathy, Cardiomyopathy, not specified |
| 794728083 | DSG2 | NM_001943.3(DSG2): c.769C>T (p.Gln257Ter) | CCTGTAAAACAAGCTYAAGTTCA | Cardiomyopathy |
| 121912998 | DSP | NM_004415.2(DSP): c.88G>A (p.Val30Met) | GAGRTGACCAGCGGCGGCGGGGG, CGAGRTGACCAGCGGCGGCGGGG, ACGAGRTGACCAGCGGCGGCGGG, TACGAGRTGACCAGCGGCGGCGG | Arrhythmogenic right ventricular cardiomyopathy, Arrhythmogenic right ventricular cardiomyopathy, type 8, not specified, not provided |
| 121912999 | DSP | NM_004415.2(DSP): c.8501G>A (p.Arg2834His) | CTCRCTCCGGATCTCGCTCCGGG, TCTCRCTCCGGATCTCGCTCCGG | Arrhythmogenic right ventricular cardiomyopathy, type 8 |
| 397516943 | DSP | NM_004415.2(DSP): c.478C>T (p.Arg160Ter) | CCATCAGTGTCCCYGAGTCCGC | Arrhythmogenic right ventricular cardiomyopathy, type 8, not provided |
| 767643821 | DSP | NM_004415.2(DSP): c.3805C>T (p.Arg1269Ter) | CCACTGAGCAGCGAAGGYGAGCT | not provided |
| 397509411 | DYNC1H1 | NM_001376.4(DYNC1H1): c.10151G>A (p.Arg3384Gln) | AATCRGGCTTCCCTGGCTTGCGG | Mental retardation, autosomal dominant 13 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906740 | DYNC1H1 | NM_001376.4(DYNC1H1): c.4552G>A (p.Glu1518Lys) | TGAARAGGATGCTCTCAGCTGGG, TTGAARAGGATGCTCTCAGCTGG | Mental retardation, autosomal dominant 13 |
| 201479015 | DYNC2H1 | NM_001080463.1(DYNC2H1): c.11747G>A (p.Gly3916Asp) | TAGRTGCCAAAGATGTACAATGG | Short-rib thoracic dysplasia 3 with or without polydactyly, not provided |
| 367643250 | DYRK1B | NM_004714.2(DYRK1B): c.304C>T (p.Arg102Cys) | CACTGCRCACGATGTAGTCATGG | Abdominal obesity-metabolic syndrome 3 |
| 794727343 | DYSF | NM_003494.3(DYSF): c.1956G>A (p.Trp652Ter) | CTGRGGTAACGTGAAACCTGTGG | Miyoshi muscular dystrophy 1, Limb-girdle muscular dystrophy, type 2B, Myopathy, distal, with anterior tibial onset |
| 201869739 | DYSF | NM_003494.3(DYSF): c.937+1G>A | CCCRTGAGTTCTCACCACTTTGG | Limb-girdle muscular dystrophy, type 2B, not provided |
| 745891180 | DYSF | NM_003494.3(DYSF): c.5057+5G>A | GTGTGTACRTGGATGGGGGCTGG | Limb-girdle muscular dystrophy, type 2B |
| 398123763 | DYSF | NM_003494.3(DYSF): c.1053+1G>A | GCCTRTGAGTACATTTCCCTGGG, CGCCTRTGAGTACATTTCCCTGG | Limb-girdle muscular dystrophy, type 2B, not provided |
| 398123794 | DYSF | NM_003494.3(DYSF): c.5509G>A (p.Asp1837Asn) | TGAGCRACATTTATGTGAAAGGG, ATGAGCRACATTTATGTGAAAGG | Limb-girdle muscular dystrophy, type 2B, not provided |
| 794727636 | DYSF | NM_003494.3(DYSF): c.265C>T (p.Arg89Ter) | CCAAGGTCCCACTCYGAGAGGTC | Miyoshi muscular dystrophy 1, Limb-girdle muscular dystrophy, type 2B |
| 727503911 | DYSF | NM_003494.3(DYSF): c.3832C>T (p.Gln1278Ter) | CCTCTTTTGAGCTCATCYAGAGA | Limb-girdle muscular dystrophy, type 2B, not provided |
| 398123773 | DYSF | NM_003494.3(DYSF): c.2311C>T (p.Gln771Ter) | CCCTGCAGCTCTGGAGYAGGCGG, CCTGCAGCTCTGGAGYAGGCGGA | Limb-girdle muscular dystrophy, type 2B, not provided |
| 398123789 | DYSF | NM_003494.3(DYSF): c.4756C>T (p.Arg1586Ter) | CCGTATCTACATTGTCYGAGCAT | Miyoshi muscular dystrophy 1, Limb-girdle muscular dystrophy, type 2B, not provided |
| 397514594 | EARS2 | NM_001083614.1(EARS2): c.500G>A (p.Cys167Tyr) | TCGGTRCAGGAACATGAGCCAGG | Combined oxidative phosphorylation deficiency 12 |
| 376103091 | EARS2 | NM_001083614.1(EARS2): c.322C>T (p.Arg108Trp) | CCCCRGCGGGGCTCTCATCAGG | Combined oxidative phosphorylation deficiency 12 |
| 104894792 | EBP | NM_006579.2(EBP): c.386G>A (p.Trp129Ter) | TGTRGGGACCACTCAGCCTGTGG | Chondrodysplasia punctata 2 X-linked dominant |
| 104894794 | EBP | NM_006579.2(EBP): c.587G>A (p.Trp196Ter) | GCCCTGTRGCTGGTGCTGCCTGG | Chondrodysplasia punctata 2 X-linked dominant |
| 104894798 | EBP | NM_006579.2(EBP): c.87G>A (p.Trp29Ter) | CCCACCTGRCATATACTGGCTGG | Chondrodysplasia punctata 2 X-linked dominant |
| 104894799 | EBP | NM_006579.2(EBP): c.187C>T (p.Arg63Ter) | CCCATTGGGGACTTGGCGGYGAC, CCATTGGGGACTTGGCGGYGACT | Chondrodysplasia punctata 2 X-linked dominant |
| 587783613 | EBP | NM_006579.2(EBP): c.328C>T (p.Arg110Ter) | CCAAGGGAGACAGCYGATACATC | Chondrodysplasia punctata 2 X-linked dominant |
| 587776498 | ECHS1 | NM_004092.3(ECHS1): c.5C>T (p.Ala2Val) | CCAGAGAGCCATGGYCGCCCTGC | Leigh disease, MITOCHONDRIAL SHORT-CHAIN ENOYL-CoA HYDRATASE 1 DEFICIENCY |
| 121909114 | ECM1 | NM_004425.3(ECM1): c.1036C>T (p.Gln346Ter) | CCAGCTGGAGAGGGAGTTCYAGC | Lipid proteinosis |
| 121909115 | ECM1 | NM_004425.3(ECM1): c.157C>T (p.Arg53Ter) | CCCCTCCCCACCCCTATCCYGAA, CCCTCCCCACCCCTATCCYGAAG, CCTCCCCACCCCTATCCYGAAGC, CCCCACCCCTATCCYGAAGCTC | Lipid proteinosis |
| 397516677 | EDA | NM_001399.4(EDA): c.871G>A (p.Gly291Arg) | CAGCRGGGAGCTGGAGGTACTGG | Hypohidrotic X-linked ectodermal dysplasia |
| 727504537 | EDA | NM_001399.4(EDA): c.396+1G>A | CCAGRTGAGTCACCTAGTAGGGG, ACCAGRTGAGTCACCTAGTAGGG, CACCAGRTGAGTCACCTAGTAGG | Hypohidrotic X-linked ectodermal dysplasia |
| 132630310 | EDA | NM_001399.4(EDA): c.67C>T (p.Gln23Ter) | CCGCGGGAGCGAGGGAGCYAGGG | Hypohidrotic X-linked ectodermal dysplasia |
| 132630315 | EDA | NM_001399.4(EDA): c.626C>T (p.Pro209Leu) | CCAGGGATTCCTGGAATTCYAGG | Hypohidrotic X-linked ectodermal dysplasia, not specified |
| 727503007 | EDA | NM_001399.4(EDA): c.676C>T (p.Gln226Ter) | CCAGGTCCTCCTGGTCCTYAAGG | Hypohidrotic X-linked ectodermal dysplasia |
| 121908450 | EDAR | NM_022336.3(EDAR): c.266G>A (p.Arg89His) | AGGCRTCACAAAGACTGTGAGGG, CAGGCRTCACAAAGACTGTGAGG | Autosomal recessive hypohidrotic ectodermal dysplasia syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908453 | EDAR | NM_022336.3(EDAR): c.1259G>A (p.Arg420Gln) | GATTGAGCRGCTGGATGCTGTGG | Autosomal dominant hypohidrotic ectodermal dysplasia |
| 121908452 | EDAR | NM_022336.3(EDAR): c.1072C>T (p.Arg358Ter) | CCTCGAGAAGACTAGCYGAATGC | |
| 74315309 | EDARADD | NM_080738.3(EDARADD): c.424G>A (p.Glu142Lys) | CTATGACRAATTGTGCTTCCTGG | Autosomal recessive hypohidrotic ectodermal dysplasia syndrome, Ectodermal dysplasia 11b, hypohidrotic/hair/tooth type, autosomal recessive |
| 121434491 | EFEMP1 | NM_001039348.2(EFEMP1): c.1033C>T (p.Arg345Trp) | CCACAAATGAATGCYGGGAGGAT | Doyne honeycomb retinal dystrophy, Malattia leventinese |
| 193302866 | EFEMP2 | NM_016938.4(EFEMP2): c.800G>A (p.Cys267Tyr) | TTCTCCTRCCACTGCCCACAGGG, TTTCTCCTRCCACTGCCCACAGG | Autosomal recessive cutis laxa type IA, Autosomal recessive cutis laxa type 1B |
| 119489102 | EFEMP2 | NM_016938.4(EFEMP2): c.835C>T (p.Arg279Cys) | CCAGCTGCTGGCCACAYGCCTCT | Autosomal recessive cutis laxa type IA, Autosomal recessive cutis laxa type 1B |
| 387906878 | EFTUD2 | NM_004247.3(EFTUD2): c.2770C>T (p.Gln924Ter) | CCGCCCCTTGGAGCCAYAGCCAG | Growth and mental retardation, mandibulofacial dysostosis, microcephaly, and cleft palate |
| 104894161 | EGR2 | NM_000399.3(EGR2): c.1075C>T (p.Arg359Trp) | CCGCTCTGACGAGCTGACAYGGC | Dejerine-Sottas disease, Charcot-Marie-Tooth disease, type 1D |
| 587777208 | EIF2AK4 | NM_001013703.3(EIF2AK4): c.3448C>T (p.Arg1150Ter) | CCGCGCAAGTTAGATYGATTTCA | Familial pulmonary capillary hemangiomatosis |
| 104894427 | EIF2B2 | NM_014239.3(EIF2B2): c.547C>T (p.Arg183Ter) | CCTCAAAGAGGCTGCCYGAAAGA | Ovarioleukodys trophy |
| 113994033 | EIF2B4 | NM_001034116.1(EIF2B4): c.1070G>A (p.Arg357Gln) | GCGGTTTCRGGTGGTAGTGGTGG | Leukoencephalopathy with vanishing white matter |
| 113994037 | EIF2B4 | NM_001034116.1(EIF2B4): c.1191+1G>A | AGAGRTAAGTACAGAGGAAAAGG | Leukoencephalopathy with vanishing white matter |
| 113994027 | EIF2B4 | NM_001034116.1(EIF2B4): c.683C>T (p.Ala228Val) | CCAATGCCCGGTGTATTGYCCTG | Leukoencephalopathy with vanishing white matter |
| 113994055 | EIF2B5 | NM_003907.2(EIF2B5): c.583C>T (p.Arg195Cys) | CCCCCAGCCACCCAACTYGTTGC, CCCCAGCCACCCAACTYGTTGCC, CCCAGCCACCCAACTYGTTGCCA, CCAGCCACCCAACTYGTTGCCAC | Ovarioleukodystrophy |
| 119484086 | ELAC2 | NM_018127.6(ELAC2): c.2342G>A (p.Arg781His) | GGAGGAGCRCAGGGAGAAGCGGG | Prostate cancer, hereditary, 2 |
| 137854450 | ELANE | NM_001972.2(ELANE): c.377C>T (p.Ser126Leu) | CCGCCACAGCTCAACGGGTYGGC, CCACAGCTCAACGGGTYGGCCAC | Severe congenital neutropenia autosomal dominant |
| 727503035 | ELN | NM_000501.3(ELN): c.1918+1G>A | GTTTGRTGAGCACTGGGTGGAGG, CCAGTTTGRTGAGCACTGGGTGG | Supravalvar aortic stenosis |
| 137854452 | ELN | NM_000501.3(ELN): c.1324C>T (p.Gln442Ter) | CCTTGTAGCCGAAGCTYAGGCAG | Supravalvar aortic stenosis |
| 515726212 | EPB42 | NM_000119.2(EPB42): c.949C>T (p.Arg317Cys) | CCACGCRGGCAGGGATTCCCAGG | Spherocytosis type 5 |
| 267606785 | EPCAM | NM_002354.2(EPCAM): c.197G>A (p.Cys66Tyr) | TGCCAAATRTTTGGTGATGAAGG | Diarrhea 5, with tufting enteropathy, congenital |
| 116506614 | EPHA2 | NM_004431.3(EPHA2): c.2162G>A (p.Arg721Gln) | CCAGCTGCGATGCCCYGCAGCAT | |
| 28933368 | ERBB2 | NM_001005862.2(ERBB2): c.2650G>A (p.Glu884Lys) | GTGGRAGCTGATGACTTTTGGGG, TGTGGRAGCTGATGACTTTTGGG, GTGTGGRAGCTGATGACTTTTGG | Glioma susceptibility 1 |
| 121913023 | ERCC2 | NM_000400.3(ERCC2): c.2041G>A (p.Asp681Asn) | GCCRACAAGGTGCAGCTTCAGGG, TGCCRACAAGGTGCAGCTTCAGG | Cerebrooculofacioskeletal syndrome 2 |
| 41556519 | ERCC2 | NM_000400.3(ERCC2): c.2047C>T (p.Arg683Trp) | CCTGCGCTTCTGCCCACAGYGGT | Xeroderma pigmentosum, group D |
| 121913017 | ERCC2 | NM_000400.3(ERCC2): c.2176C>T (p.Gln726Ter) | CCTGCGGCAGATGGCAYAGCCCT | Xeroderma pigmentosum, group D |
| 121913021 | ERCC2 | NM_000400.3(ERCC2): c.1972C>T (p.Arg658Cys) | CCTTCGATGCCATGYGCCACGCG | Photosensitive trichothiodystrophy |
| 121913024 | ERCC2 | NM_000400.3(ERCC2): c.1846C>T (p.Arg616Trp) | CCAGTGCACCACTACGGGYGGGC | Cerebro-oculo-facio-skeletal syndrome, Xeroderma pigmentosum, group D, Cerebrooculofacioskeletal syndrome 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913026 | ERCC2 | NM_000400.3(ERCC2): c.2164C>T (p.Arg722Trp) | CCAAGTACTTCCTGYGGCAGATG | Photosensitive trichothiodystrophy |
| 121913047 | ERCC3 | NM_000122.1(ERCC3): c.1273C>T (p.Arg425Ter) | CCTGGGAGGCCGAGYGAGTCATG | Xeroderma pigmentosum, complementation group b |
| 121917904 | ERCC6 | NM_000124.3(ERCC6): c.2047C>T (p.Arg683Ter) | CCGATGCAAAATAACCTCYGAGA | Cerebro-oculo-facio-skeletal syndrome |
| 121434325 | ERCC8 | NM_000082.3(ERCC8): c.479C>T (p.Ala160Val) | CCAAGCACTGTTTGGTAGYAGGT | Cockayne syndrome type A, not provided |
| 587777006 | ERF | NM_006494.3(ERF): c.547C>T (p.Arg183Ter) | TGAGCCTCRGCCCAGGCGGCGGG | Craniosynostosis 4 |
| 587777010 | ERF | NM_006494.3(ERF): c.1270C>T (p.Gln424Ter) | TCTRTGGTGGCGGGGCGGTGGG, ATCTRTGGTGGCGGGGCGGTGG, TTGATCTRTGGTGGCGGGGCGG | Craniosynostosis 4 |
| 56025238 | ERMAP | NM_001017922.1(ERMAP): c.169G>A (p.Gly57Arg) | GCCCRGGACGGTACCCAAGGAGG, CTGGCCCRGGACGGTACCCAAGG | |
| 80359865 | ESCO2 | NM_001017420.2(ESCO2): c.1354-18G>A | TCTTRGTTTTTAAAATCATTAGG | Roberts-SC phocomelia syndrome |
| 80359850 | ESCO2 | NM_001017420.2(ESCO2): c.604C>T (p.Gln202Ter) | CCAAAAAATAAAACCAYAAGTTA | Roberts-SC phocomelia syndrome |
| 121908136 | ESPN | NM_031475.2(ESPN): c.2321G>A (p.Arg774Gln) | GGCRGAAGGTGGGTGGGGCGGGG, AGGCRGAAGGTGGGTGGGGCGGG, GAGGCRGAAGGTGGGTGGGGCGG, GCAGAGGCRGAAGGTGGGTGGGG | Deafness, without vestibular involvement, autosomal dominant |
| 104893956 | ESR1 | NM_001122742.1(ESR1): c.469C>T (p.Arg157Ter) | CCAAATTCAGATAATYGACGCCA | Estrogen resistance |
| 119458971 | ETFA | NM_000126.3(ETFA): c.346G>A (p.Gly116Arg) | CTGCCTTCRGAAAGGTGAGAAGG | Glutaric acidemia IIA |
| 104894677 | ETFB | NM_001985.2(ETFB): c.491G>A (p.Arg164Gln) | GTGGAGCRGGAGATCGATGGGGG, AGTGGAGCRGGAGATCGATGGGG | Glutaric acidemia IIB |
| 796051960 | ETFDH | NM_004453.3(ETFDH): c.1809G>A (p.Trp603Ter) | AACTGRGTGGTACCTGAAGGTGG, ATTAACTGRGTGGTACCTGAAGG | not provided |
| 724159946 | ETV6 | NM_001987.4(ETV6): 6G>A (p.Arg369Gln) | TTCCRGATAGTGGATCCCAACGG | Hematologic neoplasm, Thrombocytopenia, Thrombocytopenia 5 |
| 724159947 | ETV6 | NM_001987.4(ETV6): c.641C>T (p.Pro214Leu) | CCGCCGCCTCTCCCYGGCTGAGA | Hematologic neoplasm, Thrombocytopenia, Thrombocytopenia 5 |
| 121909199 | EYA1 | NM_000503.5(EYA1): c.1276G>A (p.Gly426Ser) | GTGTACGGRGCGGTGTGGACTGG | |
| 527236064 | EYS | NM_001142800.1(EYS): c.7793G>A (p.Gly2598Asp) | CCTGAGGRCCACCCAAATGCTGG | Retinitis pigmentosa |
| 794727631 | EYS | NM_001142800.1(EYS): c.490C>T (p.Arg164Ter) | CCTTGTCCACTGGGACTTYGACT | Retinitis pigmentosa 25 |
| 587783625 | EZH2 | NM_004456.4(EZH2): c.1876G>A (p.Val626Met) | CATCTGACRTGGCAGGCTGGGGG | Weaver syndrome |
| 61753266 | F10 | NM_000504.3(F10): c.424G>A (p.Glu142Lys) | CCACRAGGAACAGAACTCTGTGG | Factor X deficiency |
| 121913071 | F13A1 | NM_000129.3(F13A1): c.782G>A (p.Arg261His) | CAGCCRTGTGGGGTCTGCAATGG | Factor xiii, a subunit, deficiency of |
| 121913065 | F13A1 | NM_000129.3(F13A1): c.514C>T (p.Arg172Ter) | CCCTATGGCGTACTTYGAACCAG, CCCTATGGCGTACTTYGAACCAGT | Factor xiii, a subunit, deficiency of |
| 267606787 | F13A1 | NM_000129.3(F13A1): c.2110C>T (p.Arg704Trp) | CCCTGGGTCTCTGGGCATYGGAA, CCTGGGTCTCTGGGCATYGGAAG | Factor xiii, a subunit, deficiency of |
| 267606789 | F13A1 | NM_000129.3(F13A1): c.1984C>T (p.Arg662Ter) | CCTTTAAAAGAAACCCTGYGAAA | Factor xiii, a subunit, deficiency of |
| 21918482 | F2 | NM_000506.3(F2): c.1292G1>A (p.Arg431His) | TCCCRCACCAGGTACAGAACTGG | |
| 121918483 | F2 | NM_000506.3(F2): c.1027G>A (p.Glu343Lys) | GTTCRAGAAGAAGTCGCTGGAGG | Hereditary factor II deficiency disease |
| 121918484 | F2 | NM_000506.3(F2): c.1054G>A (p.Glu352Lys) | TCTGTTCRAGAAGAAGTCGCTGG, CAAAACCRAAAGAGAGCTCCTGG | Hereditary factor II deficiency disease |
| 386834228 | F5 | NM_000130.4(F5): c.5668G>A (p.Glu1890Lys) | TTGGARAAAACCAGAGAGCAGGG, GTTGGARAAAACCAGAGAGCAGG | not provided |
| 36209567 | F7 | NM_000131.4(F7): c.1061C>T (p.Ala354Val) | CCGTGGCGCCACGGYCCTGGAGC | Factor VII deficiency |
| 137852373 | F8 | NM_000132.3(F8): c.5167G>A (p.Glu1723Lys) | GTGRAGAGGCTCTGGGATTATGG | Hereditary factor VIII deficiency disease |
| 137852466 | F8 | NM_000132.3(F8): c.6545G>A (p.Arg2182His) | ACTCTTCRCATGGAGTTGATGGG, CACTCTTCRCATGGAGTTGATGG | Hereditary factor VIII deficiency disease |
| 28933681 | F8 | NM_000132.3(F8): c.5710G>A (p.Glu1904Lys) | TCTTTGATRAGACCAAAAGCTGG | Hereditary factor VIII deficiency disease |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852357 | F8 | NM_000132.3(F8): c.6496C>T (p.Arg2166Ter) | CCCTCCAATTATTGCTYGATACA, CCTCCAATTATTGCTYGATACAT | Hereditary factor VIII deficiency disease |
| 137852364 | F8 | NM_000132.3(F8): c.1171C>T (p.Arg391Cys) | CCTTCCTTTATCCAAATTYGCTC, CCTTTATCCAAATTYGCTCAGTT | Hereditary factor VIII deficiency disease |
| 137852368 | F8 | NM_000132.3(F8): c.1063C>T (p.Arg355Ter) | CCAGAGGAACCCCAACTAYGAAT | Hereditary factor VIII deficiency disease |
| 137852393 | F8 | NM_000132.3(F8): c.493C>T (p.Pro165Ser) | CCTGAAAGAGAATGGTYCAATGG | Hereditary factor VIII deficiency disease |
| 137852401 | F8 | NM_000132.3(F8): c.881C>T (p.Thr294Ile) | CCTCGAAGGTCACAYATTTCTTG | Hereditary factor VIII deficiency disease |
| 137852416 | F8 | NM_000132.3(F8): c.1636C>T (p.Arg546Trp) | CCAACTAAATCAGATCCTYGGTG | Hereditary factor VIII deficiency disease |
| 137852428 | F8 | NM_000132.3(F8): c.1834C>T (p.Arg612Cys) | CCTCACAGAGAATATACAAYGCT | Hereditary factor VIII deficiency disease |
| 137852435 | F8 | NM_000132.3(F8): c.2149C>T (p.Arg717Trp) | CCACAACTCAGACTTTYGGAACA | Hereditary factor VIII deficiency disease |
| 137852445 | F8 | NM_000132.3(F8): c.5422C>T (p.Leu1808Phe) | CCTTCTATTCTAGCYTTATTTCT | Hereditary factor VIII deficiency disease |
| 137852453 | F8 | NM_000132.3(F8): c.6046C>T (p.Arg2016Trp) | CCAAAGCTGGAATTTGGYGGGTG | Hereditary factor VIII deficiency disease |
| 137852456 | F8 | NM_000132.3(F8): c.6263C>T (p.Ser2088Phe) | CCAAGGAGCCCTTTTYTTGGATC | Hereditary factor VIII deficiency disease |
| 137852463 | F8 | NM_000132.3(F8): c.6518C>T (p.Thr2173Ile) | CCGTTTGCACCCAAYTCATTATA | Hereditary factor VIII deficiency disease |
| 137852464 | F8 | NM_000132.3(F8): c.6532C>T (p.Arg2178Cys) | CCCAACTCATTATAGCATTYGCA, CCAACTCATTATAGCATTYGCAG | Hereditary factor VIII deficiency disease |
| 137852473 | F8 | NM_000132.3(F8): c.6967C>T (p.Arg2323Cys) | CCCACCGTTACTGACTYGCTACC, CCACCGTTACTGACTYGCTACCT | Hereditary factor VIII deficiency disease |
| 137852257 | F9 | NM_000133.3(F9): c.1069G>A (p.Gly357Arg) | TGGRGAAGAGTCTTCCACAAAGG | Hereditary factor IX deficiency disease |
| 137852267 | F9 | NM_000133.3(F9): c.1324G>A (p.Gly442Arg) | CAAATATRGAATATATACCAAGG | Hereditary factor IX deficiency disease |
| 137852275 | F9 | NM_000133.3(F9): c.1070G>A (p.Gly357Glu) | GGGRAAGAGTCTTCCACAAAGGG, TGGRGAAGAGTCTTCCACAAAGG | Hereditary factor IX deficiency disease |
| 137852272 | F9 | NM_000133.3(F9): c.484C>T (p.Arg162Ter) | CCTGTACTGAGGGATATYGACTT | Hereditary factor IX deficiency disease |
| 387907040 | FA2H | NM_024306.4(FA2H): c.460C>T (p.Arg154Cys) | CCGGTGACCAGGCCCATCYGCCT | Spastic paraplegia 35 |
| 80338901 | FAH | NM_000137.2(FAH):1062 c.1062+5G>A | TGARTATCTGGCTGCACTGAGGG, GTGARTATCTGGCTGCACTGAGG | Tyrosinemia type I, not provided |
| 587777011 | FAM111A | NM_001142519.1(FAM111A): c.1706G>A (p.Arg569His) | ACTCRTAGTATCATTGAGTTTGG | Kenny-Caffey syndrome type 2 |
| 587777238 | FAM111B | NM_198947.3(FAM111B): c.1883G>A (p.Ser628Asn) | GAARTTTCCTATCAGAGGTTTGG, CCAAAGAARTTTCCTATCAGAGG | Poikiloderma, hereditary fibrosing, with tendon contractures, myopathy, and pulmonary fibrosis |
| 137852737 | FAM134B | NM_001034850.2(FAM134B): c.433C>T (p.Gln145Ter) | CCCTGTTGCAGGTGCAYAGTTGT, CCTGTTGCAGGTGCAYAGTTGTG | Hereditary sensory and autonomic neuropathy type IIB, Hereditary sensory and autonomic neuropathy type IIA |
| 796051850 | FAM20C | NM_020223.3(FAM20C): c.1645C>T (p.Arg549Trp) | CCTGGAGGCCCTGGACCGGYGGC | Raine syndrome |
| 137854435 | FAM83H | NM_198488.3(FAM83H): c.973C>T (p.Arg325Ter) | CCCCTTCTCCTTCCCTAAAYGAG, CCCTTCTCCTTCCCTAAAYGAGC, CCTTCTCCTTCCCTAAAYGAGCG | Amelogenesis imperfecta, hypocalcification type |
| 137854440 | FAM83H | NM_198488.3(FAM83H): c.2029C>T (p.Gln677Ter) | CCTGAACCCCTGGTCYAGCGCA | Amelogenesis imperfecta, hypocalcification type |
| 387907056 | FAM83H | NM_198488.3(FAM83H): c.1366C>T (p.Gln456Ter) | CCGTGACCAGCTCTACCAGYAGC | Amelogenesis imperfecta, hypocalcification type |
| 730881731 | FANCC | NM_000136.2(FANCC): c.319C>T (p.Gln107Ter) | CCACAGAATTCTGGAYAATCAAA | Hereditary cancer-predisposing syndrome |
| 121434506 | FANCE | NM_021922.2(FANCE): c.421C>T (p.Arg141Ter) | CCCTGGGGAATTGCTGYGAAGGG, CCTGGGGAATTGCTGYGAAGGG | Fanconi anemia, complementation group E |
| 121918163 | FANCI | NM_001113378.1(FANCI): c.3854G>A (p.Arg1285Gln) | TCACRAGACTTCAAGATCAAAGG | Fanconi anemia, complementation group I |
| 121913077 | FAS | NM_000043.4(FAS): c.817C>T (p.Gln273Ter) | CCAAGACACAGCAGAAYAGAAAG | Autoimmune lymphoproliferative syndrome, type la |
| 398122955 | FAT4 | NM_024582.4(FAT4): c.7123G>A (p.Glu2375Lys) | ATTCCTRAGGATGCACCAACTGG | Van Maldergem syndrome 2, Hennekam lymphangiectasia-lymphedema syndrome 2 |
| 80338765 | FBLN5 | NM_006329.3(FBLN5): c.604G>A (p.Gly202Arg) | GAGGATRGAAGGTCTTGCCAAGG | Autosomal recessive cutis laxa type IA |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28939073 | FBLN5 | NM_006329.3(FBLN5): c.1051C>T (p.Arg351Trp) | CCCTTTACCATCTTGTACYGGGA, CCTTTACCATCTTGTACYGGGAC | Age-related macular degeneration 3 |
| 193922236 | FBN1 | NM_000138.4(FBN1): c.7806G>A (p.Trp2602Ter) | TACCAGTGRAACCAGTGTGTTGG | Thoracic aortic aneurysms and aortic dissections, Marfan syndrome |
| 794728166 | FBN1 | NM_000138.4(FBN1): c.1421G>A (p.Cys474Tyr) | ACCGGTRTGAGTGCAACAAAGGG, TACCGGTRTGAGTGCAACAAAGG | Thoracic aortic aneurysms and aortic dissections |
| 794728170 | FBN1 | NM_000138.4(FBN1): c.1583G>A (p.Cys528Tyr) | AGAATRCCGAGGTATGGTCCTGG | Thoracic aortic aneurysms and aortic dissections |
| 794728237 | FBN1 | NM_000138.4(FBN1): c.5699G>A (p.Cys1900Tyr) | CCTRTGGGAATGGAACTTGCCGG | Thoracic aortic aneurysms and aortic dissections |
| 794728240 | FBN1 | NM_000138.4(FBN1): c.5801G>A (p.Cys1934Tyr) | ATGAATRTGCAAGTGGAAATGGG, GATGAATRTGCAAGTGGAAATGG | Thoracic aortic aneurysms and aortic dissections |
| 794728257 | FBN1 | NM_000138.4(FBN1): c.6871G>A (p.Asp2291Asn) | TGTARGTAAGAGGATCCCTGTGG | Thoracic aortic aneurysms and aortic dissections |
| 794728266 | FBN1 | NM_000138.4(FBN1): c.7205-1G>A | TACARATATCGATGAATGCAAGG | Thoracic aortic aneurysms and aortic dissections |
| 397515757 | FBN1 | NM_000138.4(FBN1): c.1468+5G>A | GTACRTGATCCATCCTAGGTTGG, ATTGGTACRTGATCCATCCTAGG | Thoracic aortic aneurysms and aortic dissections, Marfan syndrome |
| 397515804 | FBN1 | NM_000138.4(FBN1): c.4259G>A (p.Cys1420Tyr) | CAGTRCCTCAATGCACCAGGAGG, GGCCAGTRCCTCAATGCACCAGG | Thoracic aortic aneurysms and aortic dissections, Marfan syndrome |
| 397515859 | FBN1 | NM_000138.4(FBN1): c.7955G>A (p.Cys2652Tyr) | CAATGAATRTGGCTCTGCGCAGG | Thoracic aortic aneurysms and aortic dissections, Marfan syndrome |
| 775417975 | FBN1 | NM_000138.4(FBN1): c.3513C>A (p.Cys1171Ter) | GGTTCACRCAACGGCCATTGGGG, AGGTTCACRCAACGGCCATTGGG | Thoracic aortic aneurysms and aortic dissections |
| 794728335 | FBN1 | NM_000138.4(FBN1): c.6425G>A (p.Cys2142Tyr) | GGACAGTRCATCAATACAGATGG | Thoracic aortic aneurysms and aortic dissections |
| 548296552 | FBN1 | NM_000138.4(FBN1): c.2926C>T (p.Arg976Cys) | ATGCRGTGGCGGCCAGCAATAGG | Thoracic aortic aneurysms and aortic dissections |
| 137854475 | FBN1 | NM_000138.4(FBN1): c.3509G>A (p.Arg1170His) | GCCRTTGCGTGAACCTCATAGGG, GGCCRTTGCGTGAACCTCATAGG | Thoracic aortic aneurysms and aortic dissections, Marfan syndrome, Marfanoid habitus, not specified, not provided |
| 137854482 | FBN1 | NM_000138.4(FBN1): c.3386G>A (p.Cys1129Tyr) | GGTGTTTRCCATAACACAGAGGG, TGGTGTTTRCCATAACACAGAGG | Marfan syndrome |
| 137854483 | FBN1 | NM_000138.4(FBN1): c.3662G>A (p.Cys1221Tyr) | TATGAATRTAGCTGTCAGCCGGG, CTATGAATRTAGCTGTCAGCCGG | Marfan syndrome |
| 137854484 | FBN1 | NM_000138.4(FBN1): c.3257G>A (p.Cys1086Tyr) | CCAGTRTGTGAACACCCCTGGGG, GCCAGTRTGTGAACACCCCTGGG, GGCCAGTRTGTGAACACCCCTGG | |
| 369294972 | FBN1 | NM_000138.4(FBN1): c.7660C>T (p.Arg2554Trp) | GAATCCCCRCTGGCATTCACAGG | Thoracic aortic aneurysms and aortic dissections, Marfan syndrome, incomplete |
| 113871094 | FBN1 | NM_000138.4(FBN1): c.4786C>T (p.Arg1596Ter) | CCTGGAGGGGAAGGTTTCYGACC | Thoracic aortic aneurysms and aortic dissections, Marfan syndrome |
| 794728262 | FBN1 | NM_000138.4(FBN1): c.7003C>T (p.Arg2335Trp) | CCCTTCCAGACAATYGGGAAGGG | Thoracic aortic aneurysms and aortic dissections |
| 730880099 | FBN1 | NM_000138.4(FBN1): c.1633C>T (p.Arg545Cys) | CCGGATCTGCAATAATGGAYGCT | Marfan syndrome |
| 794728195 | FBN1 | NM_000138.4(FBN1): c.2645C>T (p.Ala882Val) | CCTCCCTCGGTGCTGYGTGGGA | Thoracic aortic aneurysms and aortic dissections |
| 794728196 | FBN1 | NM_000138.4(FBN1): c.2671C>T (p.Gln891Ter) | CCCGTGCACCCTATGCYAAGTTG, CCGTGCACCCTATGCYAAGTTGG | Thoracic aortic aneurysms and aortic dissections |
| 794728231 | FBN1 | NM_000138.4(FBN1): c.4888C>T (p.Gln1630Ter) | CCTTTGGGAGTTTCYAGTGCCGC | Thoracic aortic aneurysms and aortic dissections |
| 397514558 | FBN1 | NM_000138.4(FBN1): c.2920C>T (p.Arg974Cys) | CCCTGCCTATTGCTGGCYGCCAC, CCTGCCTATTGCTGGCYGCCACC | Marfan syndrome, Ectopia lentis, isolated, autosomal dominant |
| 794728283 | FBN1 | NM_000138.4(FBN1): c.8038C>T (p.Arg2680Cys) | CCACCTGGTTACTTCYGCATAGG | Thoracic aortic aneurysms and aortic dissections |
| 140630 | FBN1 | NM_000138.4(FBN1): c.4930C>T (p.Arg1644Ter) | CCTGAATGAAGATACAYGAGTGT | Thoracic aortic aneurysms and aortic dissections |
| 113001196 | FBN1 | NM_000138.4(FBN1): c.6658C>T (p.Arg2220Ter) | CCTCTGCTCTGTGCCTTCYGATG | Thoracic aortic aneurysms and aortic dissections, Marfan syndrome |
| 112645512 | FBN1 | NM_000138.4(FBN1): c.1285C>T (p.Arg429Ter) | CCTCAAATTCCGGTCCCTYGACC | Marfan syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 25403 | FBN1 | NM_000138.4(FBN1): c.184C>T (p.Arg62Cys) | CCCAATGTCTGTGGATCAYGTTA, CCAATGTCTGTGGATCAYGTTAT | Marfan syndrome |
| 137852826 | FBN2 | NM_001999.3(FBN2): c.1171G>A (p.Glu391Lys) | TGTRAGCCTGGCCGCTGCTGGGG, CTGTRAGCCTGGCCGCTGCTGGG, GCTGTRAGCCTGGCCGCTGCTGG | Congenital contractural arachnodactyly |
| 121918188 | FBP1 | NM_001127628.1(FBP1): c.490G>A (p.Gly164Ser) | GCAGCCRGCTACGCACTGTATGG | Fructose-biphosphatase deficiency |
| 398123061 | FBXL4 | NM_012160.4(FBXL4): c.1444C>T (p.Arg482Trp) | CCAAGTGTAAAAAACTCYGGACC | Mitochondrial encephalomyopathy, Mitochondrial DNA depletion syndrome 13 (encephalomyopathic type), Global developmental delay |
| 121918305 | FBXO7 | NM_012179.3(FBXO7): c.65C>T (p.Thr22Met) | CCCGAGACGGAGCCGAYGCTGGG, CCGAGACGGAGCCGAYGCTGGGG | Parkinson disease 15 |
| 267606804 | FECH | NM_001012515.2(FECH): c.1243C>T (p.Pro415Ser) | CCGCTCTGTGTCAATYCTGTCTG | Erythropoietic protoporphyria |
| 121918292 | FERMT1 | NM_017671.4(FERMT1): c.787C>T (p.Gln263Ter) | CCTTATGGAACAAGGCATCYAAG | Kindler syndrome |
| 121918296 | FERMT3 | NM_178443.2(FERMT3): c.48G>A (p.Trp16Ter) | ATGRGAGCTGCGGGTGTTTGTGG | LEUKOCYTE ADHESION DEFICIENCY, TYPE III |
| 121918298 | FERMT3 | NM_178443.2(FERMT3): c.687G>A (p.Trp229Ter) | CCAGGTGRCTGGACTCGTCGCGG | LEUKOCYTE ADHESION DEFICIENCY, TYPE III |
| 121918295 | FERMT3 | NM_178443.2(FERMT3): c.1537C>T (p.Arg513Ter) | CCCCCCGTTTCCAGYGAAAGTTC | LEUKOCYTE ADHESION DEFICIENCY, TYPE III |
| 121918297 | FERMT3 | NM_178443.2(FERMT3): c.1729C>T (p.Arg577Ter) | CCTGGGCATCGCCAACAACYGAC | LEUKOCYTE ADHESION DEFICIENCY, TYPE III |
| 121909607 | FGA | NM_000508.3(FGA): c.104G>A (p.Arg35His) | CGTGCRTGGCCCAAGGGTTGTGG | Dysfibrinogenemia |
| 606231223 | FGB | NM_005141.4(FGB): c.958+13C>T | CCAGGTAACGAACAGGYATGCAA | Afibrinogenemia, congenital |
| 28935498 | FGD1 | NM_004463.2(FGD1): c.935C>T (p.Pro312Leu) | CCCAGCCACAGCCTCTGCCYTGG, CCAGCCACAGCCTCTGCCYTGGG, CCACAGCCTCTGCCYTGGGCCCC | Syndromic X-linked mental retardation 16 |
| 387906718 | FGD1 | NM_004463.2(FGD1): c.1966C>T (p.Arg656Ter) | CCAACCTCAATCTGCCTYGAACC | Aarskog syndrome |
| 118203974 | FGD4 | NM_139241.3(FGD4): c.823C>T (p.Arg275Ter) | CCAGAGCTGGAGAAAYGAATGCA | Charcot-Marie-Tooth disease, type 4H |
| 121917704 | FGF3 | NM_005247.2(FGF3): c.310C>T (p.Arg104Ter) | CCATGAACAAGAGGGGAYGACTC | Deafness with labyrinthine aplasia microtia and microdontia (LAMM) |
| 137852660 | FGF8 | NM_033163.3(FGF8): c.77C>T (p.Pro26Leu) | CCTCTAGGAAGGCCYGGGCAGGG | Kallmann syndrome 6 |
| 121918322 | FGF9 | NM_002010.2(FGF9): c.296G>A (p.Ser99Asn) | TATCARTATAGCAGTGGGCCTGG | Multiple synostoses syndrome 3 |
| 515726225 | FGFR1 | NM_023110.2(FGFR1): c.2084C>T (p.Thr695Ile) | CCAGARTGAAGATCTCCCACAGG | Kallmann syndrome 2 |
| 121909636 | FGFR1 | NM_023110.2(FGFR1): c.2038C>T (p.Gln680Ter) | CCGGATCTACACCCACYAGAGTG | Kallmann syndrome 2, Delayed puberty |
| 515726224 | FGFR1 | NM_023110.2(FGFR1): c.1460G>A (p.Gly487Asp) | CCACCTGCCCAAAGCAGYCCTCT, CCTGCCCAAAGCAGYCCTCTCCC | Kallmann syndrome 2 |
| 121918491 | FGFR2 | NM_000141.4(FGFR2): c.1032G>A (p.Ala344=) | GCTTGGCRGGTAATTCTATTGGG, TGCTTGGCRGGTAATTCTATTGG | Crouzon syndrome, Craniosynostosis |
| 121918509 | FGFR2 | NM_000141.4(FGFR2): c.1882G>A (p.Ala628Thr) | TTTARCAGCCAGAAATGTTTTGG | |
| 121913112 | FGFR3 | NM_000142.4(FGFR3): c.1537G>A (p.Asp513Asn) | CACAGACRATGCCACTGACAAGG | |
| 351855 | FGFR4 | NM_213647.2(FGFR4): c.1162G>A (p.Gly388Arg) | CCTGCCCTCGATACAGCCYGGCC, CCCTCGATACAGCCYGGCCAGCA | |
| 104894689 | FKRP | NM_024301.4(FKRP): c.764G>A (p.Trp255Ter) | CGCTRGAAGGCTGAGCGCGAGGG, GCGCTRGAAGGCTGAGCGCGAGG | Limb-girdle muscular dystrophy-dystroglycanopathy, type C5 |
| 104894681 | FKRP | NM_024301.4(FKRP): c.1343C>T (p.Pro448Leu) | CCCGAGCACTTCCTGCAGCYGCT, CCGAGCACTTCCTGCAGCYGCTG | Congenital muscular dystrophy-dystroglycanopathy without mental retardation, type B5 |
| 104894690 | FKRP | NM_024301.4(FKRP): c.400C>T (p.Arg134Trp) | CCTAGTACCTGATGGGGCYGGGG | Limb-girdle muscular dystrophy-dystroglycanopathy, type C5 |
| 587782069 | FLCN | NM_144997.5(FLCN): c.499C>T (p.Gln167Ter) | CCTGGCCAGGGGCTTCYAGCGCT | Hereditary cancer-predisposing syndrome |
| 398124523 | FLCN | NM_144997.5(FLCN): c.1060C>T (p.Gln354Ter) | CCCTCCGGCACATGAGGYAGGTA, CCTCCGGCACATGAGGYAGGTAG | not provided |
| 398124532 | FLCN | NM_144997.5(FLCN): c.1597C>T (p.Gln533Ter) | CCCAAAGAGGACACAYAGAAGCT, CCAAAGAGGACACAYAGAAGCTG | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907371 | FLNA | NM_001110556.1(FLNA): c.5217G>A (p.Thr1739=) | TGACRGTGAGGAGGGGTGGGGGG, GTGACRGTGAGGAGGGGTGGGGG, AGTGACRGTGAGGAGGGGTGGGG, AAGTGACRGTGAGGAGGGGTGGG, CAAGTGACRGTGAGGAGGGGTGG | Terminal osseous dysplasia |
| 28935473 | FLNA | NM_001110556.1(FLNA): c.3596C>T (p.Ser1199Leu) | CCATTGAGATCTGCTGGAGGCG | Melnick-Needles syndrome |
| 80338841 | FLNA | NM_001110556.1(FLNA): c.1923C>T (p.Gly641=) | CCGCAGGAGGCTGGYGAGTATGC | X-linked periventricular heterotopia, Cardiac valvular dysplasia, X-linked |
| 398123614 | FLNA | NM_001110556.1(FLNA): c.2761C>T (p.Arg921Ter) | CCAAGGGGATGCAGTGYGAGAT | X-linked periventricular heterotopia, Oto-palato-digital syndrome, type I, not provided |
| 137853310 | FLNA | NM_001110556.1(FLNA): c.544C>T (p.Gln182Ter) | CCAGAACAAGCTGCCGYAGCTGC | X-linked periventricular heterotopia |
| 137853312 | FLNA | NM_001110556.1(FLNA): c.3557C>T (p.Ser1186Leu) | CCAAGTGGACTGCTYGAGCGCGG | Frontometaphyseal dysplasia |
| 137853317 | FLNA | NM_001110556.1(FLNA): c.586C>T (p.Arg196Trp) | CCGGGACTGGCAGAGCGGCYGGG | Oto-palato-digital syndrome, type I, Oto-palato-digital syndrome, type II, not provided |
| 80356510 | FLNB | NM_001457.3(FLNB): c.1088G>A (p.Gly363Glu) | GTCCAGRGTTGGAAGCTGTAGGG, GGTCCAGRGTTGGAAGCTGTAGG | Larsen syndrome, dominant type |
| 80356513 | FLNB | NM_001457.3(FLNB): c.4756G>A (p.Gly1586Arg) | AAGACTRGGCGCTATATGATTGG | Larsen syndrome, dominant type, Larsen syndrome |
| 80356517 | FLNB | NM_001457.3(FLNB): c.1945C>T (p.Arg649Ter) | CCTTTGCTTCAGGTTYGAGCATA | Spondylocarpotarsal synostosis syndrome |
| 80356519 | FLNB | NM_001457.3(FLNB): c.2452C>T (p.Arg818Ter) | CCTCCTGCTGCTGGGYGATACAC | Spondylocarpotarsal synostosis syndrome |
| 121909654 | FLT4 | NM_182925.4(FLT4): c.2632G>A (p.Val878Met) | GTGGCCRTGAAAATGCTGAAAGG | Hereditary lymphedema type I |
| 121909656 | FLT4 | NM_182925.4(FLT4): c.3316G>A (p.Glu1106Lys) | CTCTGGRAGATCTTCTCTCTGGG, TCTCTGGRAGATCTTCTCTCTGG | Hereditary lymphedema type I |
| 121909657 | FLT4 | NM_182925.4(FLT4): c.2563G>A (p.Ala855Thr) | CGGCRCCTTCGGGAAGGTGGTGG, CTACGCRCCTTCGGGAAGGTGG | Hereditary lymphedema type I |
| 34255532 | FLT4 | NM_182925.4(FLT4): c.2860C>T (p.Pro954Ser) | CCGCAGGAGAAGTCTYCCAGCA | Hemangioma, capillary infantile |
| 267606819 | FLVCR1 | NM_014053.3(FLVCR1): c.721G>A (p.Ala241Thr) | CACCRCCGTGCTGGGCAATCAGG | Posterior column ataxia with retinitis pigmentosa |
| 72549320 | FMO3 | NM_001002294.2(FMO3): c.94G>A (p.Glu32Lys) | TTTRAGAAGAGCAATGACATTGG | Trimethylaminuria |
| 2266782 | FMO3 | NM_006894.5(FMO3): c.472G>A (p.Glu158Lys) | AAAARAGTCCTTTCCAGGTAAGG | Trimethylaminuria |
| 72549326 | FMO3 | NM_006894.5(FMO3): c.458C>T (p.Pro153Leu) | CCGGACATCATGTGTATCYCAAC | Trimethylaminuria |
| 79691946 | FOXC1 | NM_001453.2(FOXC1): c.889C>T (p.Pro297Ser) | CCGCCGCCGCCCGCGYCCTCCGC | Iridogoniodysgenesis type1, not specified, not provided |
| 104893952 | FOXC1 | NM_001453.2(FOXC1): c.67C>T (p.Gln23Ter) | CCCTACCTCGGCGGCGAGYAGAG, CCTACCTCGGCGGCGAGYAGAGC | Axenfeld-Rieger syndrome type 3 |
| 104893957 | FOXC1 | NM_001453.2(FOXC1): c.392C>T (p.Ser131Leu) | CCGCCACAACCTCTYGCTCAACG | Axenfeld-Rieger syndrome type 3 |
| 786205000 | FOXG1 | NM_005249.4(FOXG1): c.136C>T (p.Gln46Ter) | CCACAACAGCCACCACCCCYAGC | not provided |
| 786205006 | FOXG1 | NM_005249.4(FOXG1): c.610C>T (p.Leu204Phe) | CCCCGAGAAGCGGCTCACGYTCA, CCCGAGAAGCGGCTCACGYTCAA, CCGAGAAGCGGCTCACGYTCAAC | not provided |
| 796052467 | FOXG1 | NM_005249.4(FOXG1): c.701C>T (p.Ser234Phe) | CCATCCGCCACAATCTGTYCCTC, CCGCCACAATCTGTYCCTCAACA | not provided |
| 796052458 | FOXG1 | NM_005249.4(FOXG1): c.217C>T (p.Gln73Ter) | CCGCCGCCAGCAGCAGYAGCC, CCGCCGCCAGCAGCAGYAGCCGCC | not provided |
| 387906920 | FOXL2 | NM_023067.3(FOXL2): c.205G>A (p.Glu69Lys) | TCCGCRAGAGCGCGGAGAAGAGG | |
| 104893739 | FOXL2 | NM_023067.3(FOXL2): c.586C>T (p.Gln196Ter) | CCCCCAAGTACCTGYAGTCTGG, CCCCAAGTACCTGYAGTCTGGG | Blepharophimosis, ptosis, and epicanthus inversus |
| 104893741 | FOXL2 | NM_023067.3(FOXL2): c.655C>T (p.Gln219Ter) | CCCTATGCCTCCTGCYAGATGGC, CCTATGCCTCCTGCYAGATGGCG | Blepharophimosis, ptosis, and epicanthus inversus |
| 122467174 | FOXP3 | NM_014009.3(FOXP3): c.3G>A (p.MetIle) | CCGATRCCCAACCCCAGGCCTGG | Insulin-dependent diabetes mellitus secretory diarrhea syndrome |
| 120074156 | FRAS1 | NM_025074.6(FRAS1): c.8602C>T (p.Gln2868Ter) | CCTGGTGTCATTGAAYAGGTGCG | Cryptophthalmos syndrome |
| 137852209 | FRMD7 | NM_194277.2(FRMD7): c.252G>A (p.Val84=) | AGTRGACCCTGGACATCTGCGGG, CAGTRGACCCTGGACATCTGCGG | Infantile nystagmus, X-linked |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852208 | FRMD7 | NM_194277.2(FRMD7): c.1003C>T (p.Arg335Ter) | CCCATCTCAGTACCATGAAYGAC, CCATCTCAGTACCATGAAYGACA | Infantile nystagmus, X-linked |
| 121909660 | FSHR | NM_000145.3(FSHR): c.1717C>T (p.Arg573Cys) | CCAGGATCGCCAAGYGCATGGCC | Ovarian dysgenesis 1 |
| 28941768 | FTCD | NM_006657.2(FTCD): c.403C>T (p.Arg135Cys) | CCAGGATGGACAGTYGCCGGACC | Glutamate formiminotransferase deficiency |
| 104894685 | FTL | NM_000146.3(FTL): c.286G>A (p.Ala96Thr) | AGACRCCATGAAAGCTGCCATGG | Neuroferritinopathy |
| 397514540 | PTL | NM_000146.3(FTL): c.89C>T (p.Thr30Ile) | CCTGCAGGCCTCCTACAYCTACC | Hyperferritinemia cataract syndrome |
| 121909669 | FUS | NM_004960.3(FUS): c.1553G>A (p.Arg518Lys) | ACARACAGGATCGCAGGGAGAGG, TGAGCACARACAGGATCGCAGGG | Amyotrophic lateral sclerosis type 6 |
| 267606831 | FUS | NM_004960.3(FUS): c.1520G>A (p.Gly507Asp) | TGGCTTTGRCCCTGGCAAGATGG | Amyotrophic lateral sclerosis type 6 |
| 387906628 | FUS | NM_004960.3(FUS): c.616G>A (p.Gly206Ser) | CAGCRGTGGCTATGGACAGCAGG | Amyotrophic lateral sclerosis type 6 |
| 104894569 | G6PC | NM_000151.3(G6PC): c.551G>A (p.Gly184Glu) | GCTGRAGTCCTGTCAGGTATGGG, TGCTGRAGTCCTGTCAGGTATGG | Glycogen storage disease type 1A |
| 1801176 | G6PC | NM_000151.3(G6PC): c.248G>A (p.Arg83His) | TGGACAGCRTCCATACTGGTGGG | Glucose-6-phosphate transport defect |
| 137852316 | G6PD | NM_000402.4(G6PD): c.1268G>A (p.Arg423His) | GATCCRCGTGCAGCCCAACGAGG | Anemia, nonspherocytic hemolytic, due to G6PD deficiency |
| 137852346 | G6PD | NM_000402.4(G6PD): c.896G>A (p.Cys299Tyr) | GATGCTGTRTCTGGTGGCCATGG | Anemia, nonspherocytic hemolytic, due to G6PD deficiency |
| 267606836 | G6PD | NM_000402.4(G6PD): c.634C>T (p.Arg212Trp) | CCTGCAGAGCTCTGACYGGCTGT | |
| 398123546 | G6PD | NM_000402.4(G6PD): c.1450C>T (p.Arg484Cys) | CCAGATGCACTTCGTGYGCAGGT | Favism, susceptibility to, Anemia, nonspherocytic hemolytic, due to G6PD deficiency, not provided |
| 137852330 | G6PD | NM_000402.4(G6PD): c.682C>T (p.Arg228Cys) | CCGTGAGGACCAGATCTACYGCA | |
| 137852334 | G6PD | NM_000402.4(G6PD): c.1249C>T (p.Arg417Cys) | CCACCAGCAGTGCAAGYGCAACG | Anemia, nonspherocytic hemolytic, due to G6PD deficiency |
| 137852345 | G6PD | NM_000402.4(G6PD): c.1172C>T (p.Ala391Val) | CCTGCGCTGCGGCAAGGYCCTGA | |
| 28937909 | GAA | NM_000152.3(GAA): c.1927G>A (p.Gly643Arg) | CTGGTCRGGGCCGACGTCTGCGG | GLYCOGEN STORAGE DISEASE II, ADULT FORM |
| 796051877 | GAA | NM_000152.3(GAA): c.1437G>A (p.Lys479=) | GAARGTAGGGCGAGGGTCCAGGG, GGAARGTAGGGCGAGGGTCCAGG | Glycogen storage disease, type II |
| 369532274 | GAA | NM_000152.3(GAA): c.2512C>T (p.Gln838Ter) | CCACAGAGTCCCGCYAGCAGCCC | Glycogen storage disease, type II, not provided |
| 121907942 | GAA | NM_000152.3(GAA): c.1634C>T (p.Pro545Leu) | CCCACCCTACGTGCYTGGTCAGC | GLYCOGEN STORAGE DISEASE II, ADULT FORM |
| 121907943 | GAA | NM_000152.3(GAA): c.2560C>T (p.Arg854Ter) | CCAAGGGTGGGGAGGCCYGAGGG | Glycogen storage disease, type II |
| 587777308 | GABRA1 | NM_000806.5(GABRA1): c.335G>A (p.Arg112Gln) | CCTCCRGTTAAATAACCTAATGG | Epileptic encephalopathy, early infantile, 19, not specified, not provided |
| 397514737 | GABRG2 | NM_000816.3(GABRG2): c.968G>A (p.Arg323Gln) | TGCCCRGAAATCGCTCCCCAAGG | Generalized epilepsy with febrile seizures plus 3, not provided |
| 121909673 | GABRG2 | NM_000816.3(GABRG2): c.245G>A (p.Arg82Gln) | AAACTTCRGCCTGATATAGGAGG | Epilepsy, childhood absence 2, Familial febrile seizures 8, not provided |
| 121909674 | GABRG2 | NM_198903.2(GABRG2): c.1312C>T (p.Gln438Ter) | CCCAAGATCAGCAACCATTYAAA, CCAAGATCAGCAACCATTYAAAT | Generalized epilepsy with febrile seizures plus 3 |
| 796052504 | GABRG2 | NM_000816.3(GABRG2): c.406C>T (p.Arg136Ter) | CCATTAAAGTCCTCYGATTGAAC | not provided |
| 28940882 | GALE | NM_000403.3(GALE): c.269G>A (p.Gly90Glu) | TTTGCGGRGCTCAAGGCCGTGGG, CTTTGCGGRGCTCAAGGCCGTGG | UDPglucose-4-epimerase deficiency |
| 28940885 | GALE | NM_000403.3(GALE): c.956G>A (p.Gly319Glu) | TGGRGTGGACAGCAGCCTTAGG, CTGGRGTGGACAGCAGCCTTAGG | UDPglucose-4-epimerase deficiency, not provided |
| 137853860 | GALE | NM_000403.3(GALE): c.715C>T (p.Arg239Trp) | CCCTTCTCTGCAGGTGTCYGGGA, CCTTCTCTGCAGGTGTCYGGGAT | UDPglucose-4-epimerase deficiency |
| 111033608 | GALK1 | NM_000154.1(GALK1): c.1144C>T (p.Gln382Ter) | CCACCTTCTACCTCTCYTAAGCA, CCTTCTACCTCTCYTAAGCAGCC | Deficiency of galactokinase |
| 118204447 | GALNS | NM_000512.4(GALNS): c.178G>A (p.Asp60Asn) | TTGRACCGGATGGCTGCAGAAGG | Mucopolysaccharidosis, MPS-IV-A |
| 398123438 | GALNS | NM_000512.4(GALNS): c.463G>A (p.Gly155Arg) | CACRGATTTGATGAGTGGTTTGG, TGAAGCACRGATTTGATGAGTGG | Mucopolysaccharidosis, MPS-IV-A, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118204437 | GALNS | NM_000512.4(GALNS): c.1156C>T (p.Arg386Cys) | CCTATCTTCTATTACYGTGGCGA | Mucopolysaccharidosis, MPS-IV-A, not provided |
| 367543255 | GALT | NM_000155.3(GALT): c.389G>A (p.Cys130Tyr) | CATGTRCTTCCACCCCTGGTCGG | Deficiency of UDPglucose-hexose-1-phosphate uridylyltransferase |
| 111033829 | GALT | NM_000155.3(GALT): c.98G>A (p.Arg33His) | TATCCRCTACAACCCGCTGCAGG | Deficiency of UDPglucose-hexose-1-phosphate uridylyltransferase |
| 111033675 | GALT | NM_000155.3(GALT): c.368G>A (p.Arg123Gln) | CTCRAGGAGTCTGGTAACTATGG | Deficiency of UDPglucose-hexose-1-phosphate uridylyltransferase |
| 111033694 | GALT | NM_000155.3(GALT): c.443G>A (p.Arg148Gln) | TCCRGGCTGTTGTTGATGCATGG | Deficiency of UDPglucose-hexose-1-phosphate uridylyltransferase |
| 111033704 | GALT | NM_000155.3(GALT): c.462G>A (p.Trp154Ter) | TGCATGRGCCTCAGTCACAGAGG | Deficiency of UDPglucose-hexose-1-phosphate uridylyltransferase |
| 111033723 | GALT | NM_000155.3(GALT): c.564+1G>A | CTGCCAGRTAAGGGTGTCAGGGG, ACTGCCAGRTAAGGGTGTCAGGG | Deficiency of UDPglucose-hexose-1-phosphate uridylyltransferase |
| 111033736 | GALT | NM_000155.3(GALT): c.607G>A (p.Glu203Lys) | GCGTGAGRAGCGATCTCAGCAGG | Deficiency of UDPglucose-hexose-1-phosphate uridylyltransferase |
| 111033747 | GALT | NM_000155.3(GALT): c.658G>A (p.Glu220Lys) | GCTAATGRAGTACAGCCGCCAGG | Deficiency of UDPglucose-hexose-1-phosphate uridylyltransferase |
| 111033784 | GALT | NM_000155.3(GALT): c.922G>A (p.Glu308Lys) | GATCARAGGCTGGGGCCAACTGG | Deficiency of UDPglucose-hexose-1-phosphate uridylyltransferase |
| 111033802 | GALT | NM_000155.3(GALT): c.983G>A (p.Arg328His) | TCCTGCRCTCTGCCACTGTCCGG | Deficiency of UDPglucose-hexose-1-phosphate uridylyltransferase |
| 367543268 | GALT | NM_000155.3(GALT): c.1060-1G>A | CCARGCTGCAGAGAGACTAAGGG, TCCARGCTGCAGAGAGACTAAGG | Deficiency of UDPglucose-hexose-1-phosphate uridylyltransferase |
| 367543266 | GALT | NM_000155.3(GALT): c.961C>T (p.His321Tyr) | CCATTGGCAGCTGCACGCTYATT | Deficiency of UDPglucose-hexose-1-phosphate uridylyltransferase |
| 111033739 | GALT | NM_000155.3(GALT): c.601C>T (p.Arg201Cys) | CCTGCCAGATATTGCCCAGYGTG, CCAGATATTGCCCAGYGTGAGGA | Deficiency of UDPglucose-hexose-1-phosphate uridylyltransferase |
| 111033774 | GALT | NM_000155.3(GALT): c.865C>T (p.Leu289Phe) | CCAAGTATGACAACYTCTTTGAG | Deficiency of UDPglucose-hexose-1-phosphate uridylyltransferase |
| 111033803 | GALT | NM_000155.3(GALT): c.986C>T (p.Ser329Phe) | CCCTCCGCTCCTGCGCTYTGCCA, CCTCCGCTCCTGCGCTYTGCCAC | Deficiency of UDPglucose-hexose-1-phosphate uridylyltransferase |
| 111033804 | GALT | NM_000155.3(GALT): c.989C>T (p.Ala330Val) | CCTCCGCTCCTGCGCTCTGYCAC, CCGCTCCTGCGCTCTGYCACTGT | Deficiency of UDPglucose-hexose-1-phosphate uridylyltransferase |
| 367543259 | GALT | NM_000155.3(GALT): c.542C>T (p.Ser181Phe) | CCATGATGGGCTGTTYTAACCCC | Deficiency of UDPglucose-hexose-1-phosphate uridylyltransferase |
| 368166217 | GALT | NM_000155.3(GALT): c.772C>T (p.Arg258Cys) | CCAGACACTGCTGCTGCCCYGTC | Deficiency of UDPglucose-hexose-1-phosphate uridylyltransferase |
| 111033649 | GALT | NM_000155.3(GALT): c.160C>T (p.Gln54Ter) | CCGCATGAAGCGGCCCTGGYAGG | Deficiency of UDPglucose-hexose-1-phosphate uridylyltransferase |
| 111033686 | GALT | NM_000155.3(GALT): c.413C>T (p.Thr138Met) | CCCCTGGTCGGATGTAAYGCTGC, CCCTGGTCGGATGTAAYGCTGCC, CCTGGTCGGATGTAAYGCTGCCA | Deficiency of UDPglucose-hexose-1-phosphate uridylyltransferase |
| 111033845 | GALT | NM_000155.3(GALT): c.770C>T (p.Pro257Leu) | CCAGACACTGCTGCTGCYCGTCG | Deficiency of UDPglucose-hexose-1-phosphate uridylyltransferase |
| 121909272 | GAMT | NM_000156.5(GAMT): c.506G>A (p.Cys169Tyr) | ACTRCAACCTCACCTCCTGGGGG, TACTRCAACCTCACCTCCTGGGG, CTACTRCAACCTCACCTCCTGGG, CCTACTRCAACCTCACCTCCTGG | Deficiency of guanidinoacetate methyltransferase |
| 80338735 | GAMT | NM_000156.5(GAMT): c.327G>A (p.Lys109=) | CAARGTGCCCCTCTGCCCGCAGG | Deficiency of guanidinoacetate methyltransferase, not provided |
| 119485089 | GAN | NM_022041.3(GAN): c.1447C>T (p.Gln483Ter) | CCGAAGTCGTGAGGACGCCYAGG | Giant axonal neuropathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894809 | GATA1 | NM_002049.3(GATA1): c.647G>A (p.Arg216Gln) | CTGTGGCRGAGGGACAGGACAGG | Thrombocytopenia, platelet dysfunction, hemolysis, and imbalanced globin synthesis |
| 387907207 | GATA1 | NM_002049.3(GATA1): c.646C>T (p.Arg216Trp) | CCACTCCACTGTGGYGGAGGGAC | Thrombocytopenia, platelet dysfunction, hemolysis, and imbalanced globin synthesis |
| 387906630 | GATA2 | NM_001145661.1(GATA2): c.761C>T (p.Pro254Leu) | CCTACCCCTCCTATGTGCYGGCG, CCCCTCCTATGTGCYGGCGGCTG | Dendritic cell, monocyte, B lymphocyte, and natural killer lymphocyte deficiency |
| 387906632 | GATA2 | NM_001145661.1(GATA2): c.1009C>T (p.Arg337Ter) | CCACTCATCAAGCCCAAGYGAAG | Lymphedema, primary, with myelodysplasia |
| 104894162 | GATA3 | NM_001002295.1(GATA3): c.829C>T (p.Arg277Ter) | CCCCACTGTGGCGGYGAGATGGC | Barakat syndrome |
| 56208331 | GATA4 | NM_002052.4(GATA4): c.1273G>A (p.Asp425Asn) | GCAGRACTCTTGGAACAGCCTGG | Multiple congenital anomalies, Tetralogy of Fallot, Atrial septal defect 2 |
| 104894074 | GATA4 | NM_002052.4(GATA4): c.155C>T (p.Ser52Phe) | CCTCCGTGCTGGGCCTGTYCTAC, CCGTGCTGGGCCTGTYCTACCTC | Atrial septal defect 2 |
| 115372595 | GATA4 | NM_002052.4(GATA4): c.1037C>T (p.Ala346Val) | CCTCCCGCCAGCGGTGYTTCCAG | Atrioventricular septal defect 4 |
| 387906769 | GATA4 | NM_002052.4(GATA4): c.487C>T (p.Pro163Ser) | CCTACTCCAGCCCCTACYCGGCT | Tetralogy of Fallot, Ventricular septal defect 1, Atrioventricular septal defect 4 |
| 387906771 | GATA4 | NM_002052.4(GATA4): c.839C>T (p.Thr280Met) | CCAGACCACCACCACCAYGCTGT | Atrial septal defect 2 |
| 387906819 | GATA6 | NM_005257.5(GATA6): c.1367G>A (p.Arg456His) | TTATGGCRCAGAAACGCCGAGGG, CTTATGGCRCAGAAACGCCGAGG | Pancreatic agenesis and congenital heart disease |
| 80356772 | GBA | NM_000157.3(GBA): c.1505G>A (p.Arg502His) | AACCRGTGAGGGCAATGGTGAGG | Gaucher disease |
| 121908311 | GBA | NM_000157.3(GBA): c.1246G>A (p.Gly416Ser) | ATGTGGTCRGCTGGACCGACTGG | Gaucher disease, Subacute neuronopathic Gaucher disease, Gaucher disease, type 1 |
| 121908298 | GBA | NM_001005741.2(GBA): c.983C>T (p.Pro328Leu) | CCAACGCTTGCTGCTGCYCCACT | Gaucher disease, type 1 |
| 398123532 | GBA | NM_001005741.2(GBA): c.625C>T (p.Arg209Cys) | CCCTGCAGTTGGCCCAGYGTCCC, CCTGCAGTTGGCCCAGYGTCCCG | Gaucher disease, type 1, not provided |
| 398123015 | GBA2 | NM_020944.2(GBA2): c.2618G>A (p.Arg873His) | TCCRCTCACTGGCCTACATGCGG | |
| 398123013 | GBA2 | NM_020944.2(GBA2): c.700C>T (p.Arg234Ter) | CCATGCCCTCTATCCCYGAGCCT | |
| 80338673 | GBE1 | NM_000158.3(GBE1): c.1571G>A (p.Arg524Gln) | TGATTCRACTCATTACGCATGGG, ATGATTCRACTCATTACGCATGG | Glycogen storage disease, type IV, GLYCOGEN STORAGE DISEASE IV, COMBINED HEPATIC AND MYOPATHIC |
| 786205862 | GCDH | NM_000159.3(GCDH): c.675G>A (p.Trp225Ter) | GTGTGRGCTCGGTGTGAAGATGG | Glutaric aciduria, type 1 |
| 147611168 | GCDH | NM_000159.3(GCDH): c.1240G>A (p.Glu414Lys) | ACACCTACRAAGGTAGGAGCTGG | Glutaric aciduria, type 1, not provided |
| 104894438 | GCH1 | NM_000161.2(GCH1): c.602G>A (p.Gly201Glu) | GCCTGCTGRAGTCGGGGTAGTGG | Dystonia 5, Dopa-responsive type |
| 104894443 | GCH1 | NM_000161.2(GCH1): c.633G>A (p.Met211Ile) | CACATRTGTATGGTAATGCGAGG | GTP cyclohydrolase I deficiency |
| 104894444 | GCH1 | NM_000161.2(GCH1): c.142C>T (p.Gln48Ter) | CCCGAGGCCAAGAGCGCGYAGCC, CCGAGGCCAAGAGCGCGYAGCCC | Dystonia 5, Dopa-responsive type |
| 193922289 | GCK | NM_000162.3(GCK): c.214G>A (p.Gly72Arg) | AGTCRGGGACTTCCTCTCCCTGG | Maturity-onset diabetes of the young, type 2 |
| 104894008 | GCK | NM_000162.3(GCK): c.781G>A (p.Gly261Arg) | CTTCRGGGACTCCGGCGAGCTGG | Maturity-onset diabetes of the young, type 2 |
| 104894012 | GCK | NM_000162.3(GCK): c.1363G>A (p.Val455Met) | CTCGGCCGRTGGCCTGTAAGAAGG | Hyperinsulinemic hypoglycemia familial 3 |
| 104894016 | GCK | NM_000162.3(GCK): c.1132G>A (p.Ala378Thr) | GCGCRCTGCGCACATGTGCTCGG | Maturity-onset diabetes of the young, type 2 |
| 397514580 | GCK | NM_000162.3(GCK): c.1015G>A (p.Glu339Lys) | GGTGRAGAGGTGTGCGGAGGAGG, GCAGGTGRAGAGGTGTGCGGAGG | Maturity-onset diabetes of the young, type 2 |
| 587780347 | GCK | NM_000162.3(GCK): c.706G>A (p.Glu236Lys) | CATGRAGGAGATGCAGAATGTGG | Diabetes mellitus, gestational |
| 104894014 | GCK | NM_000162.3(GCK): c.1367C>T (p.Ala456Val) | CCCTGGTCTCGGCGGTGGYCTGT, CCTGGTCTCGGCGGTGGYCTGTA | Hyperinsulinemic hypoglycemia familial 3 |
| 80356655 | GCK | NM_000162.3(GCK): c.683C>T (p.Thr228Met) | CCGACCTCCACCCCAGGCAYGGG, CCTCCACCCCAGGCAYGGGCTGC | Permanent neonatal diabetes mellitus, Maturity-onset diabetes of the young, type 2 |
| 56141211 | GCNT2 | NM_001491.2(GCNT2): c.1043G>A (p.Gly348Glu) | ATGRAAACGGAGACTTAAAGTGG | I blood group system |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853339 | GCNT2 | NM_145649.4(GCNT2): c.505G>A (p.Ala169Thr) | CCAGRCTGACCTGAACTGCCTGG | I blood group system |
| 397515432 | GDAP1 | NM_018972.2(GDAP1): c.980G>A (p.Gly327Asp) | GTTGRTTTGCTTGCAGGAGTGGG, GGTTGRTTTGCTTGCAGGAGTGG | Charcot-Marie-Tooth disease, recessive intermediate A |
| 387906946 | GDF3 | NM_020634.1(GDF3): c.820C>T (p.Arg274Trp) | CCAGCTATTCATTAACTTCYGGG | Microphthalmia, isolated, with coloboma 6 |
| 36119840 | GDNF | NM_000514.3(GDNF): c.277C>T (p.Arg93Trp) | TGCCRATTCCGCTCTCTTCTAGG | Congenital central hypoventilation, Hirschsprung disease 3, not specified |
| 58064122 | GFAP | NM_002055.4(GFAP): c.715C>T (p.Arg239Cys) | CCCTGAAAGAGATCYGCACGCAG | Alexander disease, not provided |
| 121908192 | GFER | NM_005262.2(GFER): c.581G>A (p.Arg194His) | ATGAGCRCTGGCGCGACGGCTGG | Myopathy, mitochondrial progressive, with congenital cataract, hearing loss, and developmental delay, not provided |
| 119470019 | GFM1 | NM_024996.5(GFM1): c.139C>T (p.Arg47Ter) | CCTAATGAAAAAATAYGAAATAT | Combined oxidative phosphorylation deficiency 1 |
| 121909678 | GGCX | NM_000821.6(GGCX): c.1672G>A (p.Gly558Arg) | GCTGCAGRGGGAAGTGACTGTGG | Pseudoxanthoma elasticum-like disorder with multiple coagulation factor deficiency |
| 121909682 | GGCX | NM_000821.6(GGCX): c.1427G>A (p.Arg476His) | TGACCRCTTCCAGCAGAGGTGGG, ATGACCRCTTCCAGCAGAGGTGG | Pseudoxanthoma elasticum-like disorder with multiple coagulation factor deficiency |
| 121909683 | GGCX | NM_000821.6(GGCX): c.763G>A (p.Val255Met) | TGCTGGTCRTGCACTGGGGTGGG | Pseudoxanthoma elasticum-like disorder with multiple coagulation factor deficiency |
| 121909680 | GGCX | NM_000821.6(GGCX): c.1120C>T (p.Gln374Ter) | CCTGCTCTACCTCCTGGAGYAGC | Pseudoxanthoma elasticum-like disorder with multiple coagulation factor deficiency |
| 121909684 | GGCX | NM_000821.6(GGCX): c.899C>T (p.Ser300Phe) | CCTAGGTATGTTCTYCTACGTCA | Pseudoxanthoma elasticum-like disorder with multiple coagulation factor deficiency |
| 387907000 | GIPC3 | NM_133261.2(GIPC3): c.903G>A (p.Trp301Ter) | AGTGTGRGCCGCCATCGGCGAGG | Deafness, autosomal recessive 15 |
| 387907002 | GIPC3 | NM_133261.2(GIPC3): c.565C>T (p.Arg189Cys) | CCCAGCCCTTCACCCTGYGCCTG, CCAGCCCTTCACCCTGYGCCTGG | Deafness, autosomal recessive 15 |
| 104893963 | GJA1 | NM_000165.4(GJA1): c.61G>A (p.Gly21Arg) | CAACTGCTRGAGGGAAGGTGTGG | Oculodentodigital dysplasia |
| 104893965 | GJA1 | NM_000165.4(GJA1): c.1127G>A (p.Arg376Gln) | CAGACCTCRGCCTGATGACCTGG | Hypoplastic left heart syndrome, Atrioventricular septal defect and common atrioventricular junction |
| 28931600 | GJA1 | NM_000165.4(GJA1): c.427G>A (p.Gly143Ser) | CATRGTAAGGTGAAAATGCGAGG | Syndactyly type 3 |
| 387906616 | GJA1 | NM_000165.4(GJA1): c.31C>T (p.Leu11Phe) | CCTTAGGCAAACTCYTTGACAAG | Oculodentodigital dysplasia |
| 397514703 | GJA3 | NM_021954.3(GJA3): c.5G>A (p.Gly2Asp) | ATGGRCGACTGGAGCTTTCTGGG, AATGGRCGACTGGAGCTTTCTGG | Zonular pulverulent cataract 3 |
| 398122937 | GJA3 | NM_021954.3(GJA3): c.427G>A (p.Gly143Arg) | GCATGGCCRGGGCGCTGCTGCGG | Zonular pulverulent cataract 3 |
| 121917825 | GJA3 | NM_021954.3(GJA3): c.560C>T (p.Pro187Leu) | CCGCTGGCCCTGCCYCAACACGG | Zonular pulverulent cataract 3 |
| 387906612 | GJA5 | NM_005266.6(GJA5): c.145C>T (p.Gln49Ter) | CCTGGGGGATGAGYAGGCTGAT | Atrial fibrillation, familial, 11 |
| 397515627 | GJA8 | CNM_005267.4(GJA8): c.566>T (p.Pro189Leu) | CCGGTGGCCCTGCCYCAATGTGG | Cataract 1 |
| 786204123 | GJB1 | NM_000166.5(GJB1): c.425G>A (p.Arg142Gln) | GGTGTTCCRGCTGTTGTTTGAGG | Charcot-Marie-Tooth Neuropathy X |
| 104894814 | GJB1 | NM_001097642.2(GJB1): c.658C>T (p.Arg220Ter) | CCGGGCCTGTGCCCGCYGAGCCC | X-linked hereditary motor and sensory neuropathy |
| 104894824 | GJB1 | NM_000166.5(GJB1): c.164C>T (p.Thr55Ile) | CCTTCATCTGCAACAYACTCCAG | X-linked hereditary motor and sensory neuropathy |
| 587777876 | GJB1 | NM_000166.5(GJB1): c.77C>T (p.Ser26Leu) | CCGAGTATGGCTCTYGGTCATCT | X-linked hereditary motor and sensory neuropathy |
| 587777879 | GJB1 | NM_000166.5(GJB1): c.790C>T (p.Arg264Cys) | CCCTGAAAGACATACTGYGCCGC, CCTGAAAGACATACTGYGCCGCA | X-linked hereditary motor and sensory neuropathy |
| 587781246 | GJB1 | NM_000166.5(GJB1): c.688C>T (p.Arg230Cys) | CCGCTCCAATCCACCTTCCYGCA, CCAATCCACCTTCCYGCAAGGGC | Charcot-Marie-Tooth disease |
| 116840819 | GJB1 | NM_000166.5(GJB1): c.223C>T (p.Arg75Trp) | CCCCATCTCCCATGTGYGGCTGT, CCATCTCCCATGTGYGGCTGTG, CCATCTCCCATGTGYGGCTGTGG | X-linked hereditary motor and sensory neuropathy |
| 587783645 | GJB2 | NM_004004.5(GJB2): c.158G>A (p.Cys53Tyr) | GTCRCAACACCCTGCAGCCAGG | Hearing impairment |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338940 | GJB2 | NM_004004.5(GJB2): c.-23+1G>A | GCAGRTGAGCCCGCCGGCCCCGG | Deafness, autosomal recessive 1A, Hearing impairment |
| 104894402 | GJB2 | NM_004004.5(GJB2): c.223C>T (p.Arg75Trp) | CCCCATCTCCCACATCYGGCTAT, CCCATCTCCCACATCYGGCTATG, CCATCTCCCACATCYGGCTATGG | Deafness, autosomal dominant 3a |
| 76434661 | GJB2 | NM_004004.5(GJB2): c.416G>A (p.Ser139Asn) | CCCGGAAGAAGATGYTGCTTGTG | Deafness, autosomal recessive 1A, Hearing impairment |
| 72555392 | GLB1 | NM_000404.2(GLB1): c.176G>A (p.Arg59His) | CCCRTGTGCCCCGCTTCTACTGG | Mucopolysaccharidosis, MPS-IV-B, Infantile GM1 gangliosidosis, Juvenile GM>1<gangliosidosis, Gangliosidosis GM1 type 3, GM1-GANGLIOSIDOSIS, TYPE I, WITH CARDIAC INVOLVEMENT, not provided |
| 398123351 | GLB1 | NM_000404.2(GLB1): c.1769G>A (p.Arg590His) | GGCCRCTATTGGCCAGCCCGGGG, TGGCCRCTATTGGCCAGCCCGGG, TTGGCCRCTATTGGCCAGCCCGG | Mucopolysaccharidosis, MPS-IV-B, Infantile GM1 gangliosidosis, Juvenile GM>1<gangliosidosis, Gangliosidosis GM1 type 3, not provided |
| 398123353 | GLB1 | NM_000404.2(GLB1): c.397-1G>A | ACTARGGAGGATTACCTGCTTGG | Mucopolysaccharidosis, MPS-IV-B, Infantile GM1 gangliosidosis, Juvenile GM>1<gangliosidosis, Gangliosidosis GM1 type 3, not provided |
| 72555359 | GLB1 | NM_000404.2(GLB1): c.1369C>T (p.Arg457Ter) | CCCCCAGGGAGTCCTTGAGYGAA, CCCCAGGGAGTCCTTGAGYGAAA, CCCAGGGAGTCCTTGAGYGAAAC, CCAGGGAGTCCTTGAGYGAAACA | Infantile GM1 gangliosidosis |
| 72555366 | GLB1 | NM_000404.2(GLB1): c.622C>T (p.Arg208Cys) | CCTGCAGAAGCGCTTTYGCCACC | Mucopolysaccharidosis, MPS-IV-B, Infantile GM1 gangliosidosis, Juvenile GM>1<gangliosidosis, Gangliosidosis GM1 type 3, not provided |
| 72555370 | GLB1 | NM_000404.2(GLB1): c.202C>T (p.Arg68Trp) | CCGCTTCTACTGGAAGGACYGGC | Juvenile GM>1<gangliosidosis |
| 121964980 | GLDC | NM_000170.2(GLDC): c.2216G>A (p.Arg739His) | TCTGTCRCCCTGGAGACTTCGGG, ATCTGTCRCCCTGGAGACTTCGG | Non-ketotic hyperglycinemia |
| 121964977 | GLDC | NM_000170.2(GLDC): c.2405C>T (p.Ala802Val) | CCTGTGGGAACCGTCAGTGYGGC | Non-ketotic hyperglycinemia |
| 121917707 | GLI2 | NM_005270.4(GLI2): c.1323G>A (p.Trp441Ter) | CCACTGRGAAGACTGCACCAAGG | Holoprosencephaly 9 |
| 116840748 | GLI3 | NM_000168.5(GLI3): c.2110C>T (p.Gln704Ter) | CCCCAACAGACATCTYAGCCAAG, CCCAACAGACATCTYAGCCAAGC | Pallister-Hall syndrome |
| 116840770 | GLI3 | NM_000168.5(GLI3): c.3481C>T (p.Gln1161Ter) | CCGACCTGCCCATTYAGTGGAAC | Pallister-Hall syndrome |
| 281864919 | GLRA1 | NM_000171.3(GLRA1): c.1259G>A (p.Arg420His) | ATCCCRCATTGGCTTCCCCATGG | Hyperekplexia hereditary |
| 116474260 | GLRA1 | NM_001146040.1(GLRA1): c.1132G>A (p.Gly378Ser) | CCTGTAGACAGGCTGGGCYCATC | Hyperekplexia hereditary |
| 121909749 | GLRB | NM_000824.4(GLRB): c.752G>A (p.Gly251Asp) | GAAAGRCTACTACACATGCGTGG | Hyperekplexia 2 |
| 121909736 | GLUD1 | NM_005271.3(GLUD1): c.953G>A (p.Arg318Lys) | ATGARATATTTACATCGTTTTGG | Hyperinsulinism-hyperammonemia syndrome |
| 397509422 | GMPPB | NM_013334.3(GMPPB): c.1081G>A (p.Asp361Asn) | CCGTTGAGGTAGAGCTCATYATT | Limb-girdle muscular dystrophy-dystroglycanopathy, type C14, Congenital muscular dystrophy-dystroglycanopathy with brain and eye anomalies, type A14 |
| 397509423 | GMPPB | NM_013334.3(GMPPB): c.220C>T (p.Arg74Ter) | CCTTCCAGCTGGGAATCYGAATC | Congenital muscular dystrophy-dystroglycanopathy with brain and eye anomalies, type A14 |
| 397509424 | GMPPB | NM_013334.3(GMPPB): c.64C>T (p.Pro22Ser) | CCGCTGACGCTGAGCACCYCGAA | Limb-girdle muscular dystrophy-dystroglycanopathy, type C14 |
| 397509425 | GMPPB | NM_021971.2(GMPPB): c.553C>T (p.Arg185Cys) | CCCTGCAGTGCTGCAGYGCATCC, CCTGCAGTGCTGCAGYGCATCCA | Limb-girdle muscular dystrophy-dystroglycanopathy, type C14, Congenital muscular dystrophy-dystroglycanopathy with brain and eye anomalies, |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| | | | | type A14, Congenital muscular dystrophy-dystroglycanopathy with mental retardation, type B14 |
| 202160208 | GMPPB | NM_013334.3(GMPPB): c.860G>A (p.Arg287Gln) | CCGCAGCACCGTGCACCGCYGGA | Congenital muscular dystrophy-dystroglycanopathy with mental retardation, type B14 |
| 137853227 | GNAI2 | NM_002070.3(GNAI2): c.536G>A (p.Arg179His) | GGACCCRCGTAAAGACCACGGGG, CGGACCCRCGTAAAGACCACGGG, ACGGACCCRCGTAAAGACCACGG | Granulosa cell tumor of the ovary |
| 398122923 | GNAL | NM_001142339.2(GNAL): c.409G>A (p.Val137Met) | TGACCATRTGAAAAAACTTTGGG, TTGACCATRTGAAAAAACTTTGG | Dystonia 25 |
| 397514698 | GNAQ | NM_002072.4(GNAQ): c.548G>A (p.Arg183Gln) | GAGTTCRAGTCCCCACCACAGGG, AGAGTTCRAGTCCCCACCACAGG | Sturge-Weber syndrome, Capillary malformations, congenital, 1 |
| 121913495 | GNAS | NM_000516.5(GNAS): c.602G>A (p.Arg201His) | CGCTGCCDTGTCCTGACTTCTGG | McCune-Albright syndrome, Somatotroph adenoma, Sex cord-stromal tumor, Cushing syndrome |
| 137854539 | GNAS | NM_001077488.3(GNAS): c.347C>T (p.Pro116Leu) | CCATGAGCAACCTGGTGCYCCCC | Pseudohypoparathyroidism type 1A, Pseudopseudohypoparathyroidism |
| 121908625 | GNE | NM_001128227.2(GNE): c.1820G>A (p.Gly607Glu) | GATGRGCCTGATTGTTCCTGTGG | Inclusion body myopathy 2 |
| 62541771 | GNE | NM_001128227.2(GNE): c.1985C>T (p.Ala662Val) | GTTTCRAGCTTGGATGAGATGG | Inclusion body myopathy 2, Nonaka myopathy |
| 121434440 | GNPAT | NM_014236.3(GNPAT): c.631C>T (p.Arg211Cys) | CCTTTTTCATGCGGYGTACCTTT | Rhizomelic chondrodysplasia punctata type 2 |
| 137852885 | GNPTG | NM_032520.4(GNPTG): c.316G>A (p.Gly106Ser) | TCCTCRGGTGAGTGGGGCCGGGG, ATCCTCRGGTGAGTGGGGCCGGG, GATCCTCRGGTGAGTGGGGCCGG | Mucolipidosis III Gamma |
| 193302848 | GNPTG | NM_032520.4(GNPTG): c.196C>T (p.Arg66Ter) | CCCGTGCATCTCTTCYGACTCTC, CCGTGCATCTCTTCYGACTCTCG | Mucolipidosis III Gamma |
| 193302854 | GNPTG | NM_032520.4(GNPTG): c.610-1G>T | CCTGCATCCTCCACCTTCAYGGC | Mucolipidosis III Gamma |
| 104893842 | GNRHR | NM_000406.2(GNRHR): c.416G>A (p.Arg139His) | ACCRCTCCCTGGCTATCACGAGG | |
| 104893847 | GNRHR | NM_000406.2(GNRHR): c.959C>T (p.Pro320Leu) | CCCATGCTTTGATCYACTTATCT | |
| 267606849 | GP1BA | NM_000173.6(GP1BA): c.1620G>A (p.Trp540Ter) | CTGRCTGCTCTTTGCCTCTGTGG | Bernard-Soulier syndrome, type A1 |
| 121908063 | GP1BA | NM_000173.6(GP1BA): c.217C>T (p.Leu73Phe) | CCTGATGCCTTACACTCGCYTCA | Bernard-Soulier syndrome, type A2, autosomal dominant |
| 137853582 | GPI | NM_000175.3(GPI): c.475G>A (p.Gly159Ser) | TTGGCRGCTCCGACCTGGTGAGG | Hemolytic anemia, nonspherocytic, due to glucose phosphate isomerase deficiency |
| 137853585 | GPI | NM_000175.3(GPI): c.1615G>A (p.Asp539Asn) | CTCACRACGCTTCTACCAATGGG, TCTCACRACGCTTCTACCAATGG | Hemolytic anemia, nonspherocytic, due to glucose phosphate isomerase deficiency |
| 61754634 | GPI | NM_000175.3(GPI): c.671C>T (p.Thr224Met) | CCATCACGAATGCAGAGAYGGCG | Hemolytic anemia, nonspherocytic, due to glucose phosphate isomerase deficiency |
| 267606852 | GPI | NM_000175.3(GPI): c.14C>T (p.Thr5Ile) | CCCGCCATGGCCGCTCTCAYCCG, CCGCCATGGCCGCTCTCAYCCGG, CCATGGCCGCTCTCAYCCGGGAC | Hemolytic anemia, nonspherocytic, due to glucose phosphate isomerase deficiency |
| 58933950 | GPR143 | NM_000273.2(GPR143): c.455G>A (p.Ser152Asn) | CCATTTCCTCGGTGAATACYTCA | Ocular albinism, type I, not provided |
| 387907138 | GPR179 | NM_001004334.3(GPR179): c.598C>T (p.Arg200Ter) | CCCCTGCCCTGAAGAAGYGAGTG, CCCTGCCCTGAAGAAGYGAGTGT, CCTGCCCTGAAGAAGYGAGTTT | Congenital stationary night blindness, type 1E |
| 267606854 | GPSM2 | NM_013296.4(GPSM2): c.379C>T (p.Arg127Ter) | CCATAGTTTGTTGTCAGYGACAC | Chudley-McCullough syndrome |
| 769967246 | GPX4 | NM_001039848.2(GPX4): c.381C>A (p.Tyr127Ter) | CCTGCACGCCCGATAYGCTGAGT | Spondylometaphyseal dysplasia Sedaghatian type |
| 180177312 | GRHPR | NM_012203.1(GRHPR): c.478G>A (p.Gly160Arg) | ATCATCRGGCTGGGGCGCATAGG | Primary hyperoxaluria, type II |
| 180177314 | GRHPR | NM_012203.1(GRHPR): c.494G>A (p.Gly165Asp) | CTCTAGRCCAGGCCATTGCTCGG | Primary hyperoxaluria, type II |
| 180177322 | GRHPR | NM_012203.1(GRHPR): c.904C>T (p.Arg302Cys) | CCACCCACAGAACCYGCAACACC | Primary hyperoxaluria, type II |
| 137852350 | GRIA3 | NM_007325.4(GRIA3): c.2497G>A (p.Gly833Arg) | ACTTGTCRGAGGTCTGGGGCTGG | Mental retardation, X-linked, syndromic, wu type |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397518470 | GRIN2A | NM_000833.4(GRIN2A): c.1553G>A (p.Arg518His) | TGAGGAACRTTCTGAAGTGGTGG | Focal epilepsy with speech disorder with or without mental retardation |
| 796052571 | GRIN2B | NM_000834.3(GRIN2B): 1858G>A (p.Val620Met) | TACCTRTGCAGAACCCAAAGGGG, GTACCTRTGCAGAACCCAAAGGG, CGTACCTRTGCAGAACCCAAAGG | not provided |
| 397514556 | GRIN2B | NM_000834.3(GRIN2B): c.1658C>T (p.Pro553Leu) | CCCTTCCTCAGAGCYATTCAGCG | Mental retardation, autosomal dominant 6 |
| 63750331 | GRN | NM_002087.3(GRN): c.3G>A (p.Met1Ile) | CATRTGGACCCTGGTGAGCTGGG, CCATRTGGACCCTGGTGAGCTGG | Frontotemporal dementia, ubiquitin-positive, not provided |
| 606231221 | GRN | NM_002087.3(GRN): c.835+1G>A | GCACACAGRTACCAGAGGCAGGG | Frontotemporal dementia, ubiquitin-positive |
| 63750077 | GRN | NM_002087.3(GRN): c.373C>T (p.Gln125Ter) | CCGTGGGTGCCATCYAGTGCCCT | Frontotemporal dementia, ubiquitin-positive, not provided |
| 63751294 | GRN | NM_002087.3(GRN): c.1477C>T (p.Arg493Ter) | CCTGCAACGTGAAGGCTYGATCC | Frontotemporal dementia, ubiquitin-positive, not provided |
| 193026789 | GRN | NM_002087.3(GRN): c.1212C>A (p.Cys404Ter) | CCACCAGCACTGCTGYCCCCAGG | Frontotemporal dementia |
| 587777289 | GSC | NM_173849.2(GSC): c.400C>T (p.Gln134Ter) | CAGCATCTRGTGCGGTACCGGGG | Short stature, auditory canal atresia, mandibular hypoplasia, skeletal abnormalities |
| 121909307 | GSS | NM_000178.2(GSS): c.491G>A (p.Arg164Gln) | TGTGCACCRGTGGGTCCCCTGGG | Gluthathione synthetase deficiency |
| 121909124 | GUCA1B | NM_002098.5(GUCA1B): c.469G>A (p.Gly157Arg) | GAGAATRGAGATGGTAAGAGGGG, TGAGAATRGAGATGGTAAGAGGG, ATGAGAATRGAGATGGTAAGAGG | Retinitis pigmentosa 48, not provided |
| 61750173 | GUCY2D | NM_000180.3(GUCY2D): c.2513G>A (p.Arg838His) | CCGGGAGCRCACGGAGGAGCTGG | Cone-rod dystrophy 6, not provided |
| 121918179 | GUSB | NM_000181.3(GUSB): c.1521G>A (p.Trp507Ter) | ACTCTTGRTATCACGACTACGGG, TACTCTTGRTATCACGACTACGG | Mucopolysaccharidosis type VII |
| 398123234 | GUSB | NM_000181.3(GUSB): c.1084G>A (p.Asp362Asn) | GGGCTTCRACTGGCCGCTGCTGG | Mucopolysaccharidosis type VII, not provided |
| 377519272 | GUSB | NM_000181.3(GUSB): c.1616_1653del38 (p.Ser539Argfs*8) | CCATACTCRCTCTGAATAATGGG | Mucopolysaccharidosis type VII |
| 587779400 | GUSB | NM_000181.3(GUSB): c.530C>T (p.Thr177Ile) | CCATCAACAACACACTCAYCCCC | Mucopolysaccharidosis type VII |
| 121918181 | GUSB | NM_000181.3(GUSB): c.526C>T (p.Leu176Phe) | CCATCAACAACACAYTCACCCCC | Mucopolysaccharidosis type VII, not provided |
| 121434584 | GYS1 | NM_002103.4(GYS1): c.1384C>T (p.Arg462Ter) | CCTGACCACCATCCGCYGAATCG | Glycogen storage disease 0, muscle |
| 121918419 | GYS2 | NM_021957.3(GYS2): c.736C>T (p.Arg246Ter) | CCACCGGTACTGCATGGAGYGAG, CCGGTACTGCATGGAGYGAGCTT | Hypoglycemia with deficiency of glycogen synthetase in the liver |
| 137853101 | HADH | NM_005327.4(HADH): c.118G>A (p.Ala40Thr) | GATGGGCRCCGGCATTGCCCAGG | Deficiency of 3-hydroxyacyl-CoA dehydrogenase |
| 137853103 | HADH | NM_005327.4(HADH): c.773C>T (p.Pro258Leu) | CCGGTTACCCCATGGGCCYATTT | Hyperinsulinemic hypoglycemia, familial, 4 |
| 121913134 | HADHB | NM_000183.2(HADHB): c.1331G>A (p.Arg444Lys) | AACARATTACGGAAAGAAGGAGG, GCCAACARATTACGGAAAGAAGG | Mitochondrial trifunctional protein deficiency |
| 104894695 | HAMP | NM_021175.3(HAMP): c.166C>T (p.Arg56Ter) | CCCATGTTCCAGAGGYGAAGGAG, CCATGTTCCAGAGGYGAAGGAGG | Hemochromatosis type 2B |
| 74315322 | HAX1 | NM_006118.3(HAX1): c.568C>T (p.Gln190Ter) | CCAGATCTTGATTCCYAGGTTTC | Severe congenital neutropenia 3, autosomal recessive |
| 41417548 | HBA2 | NM_000517.4(HBA2): c.314G>A (p.Cys105Tyr) | CCACTCCTGCTGGTGACCCTGG | Hemoglobin H disease, nondeletional |
| 63750783 | HBB | NM_000518.4(HBB): c.47H>A (p.Trp16Ter) | CCTGTRGGGCAAGGTGAACGTGG | beta |
| 34999973 | HBB | NM_000518.4(HBB): c.-140C>T | CCTCACCCTGTGGAGCCAYACCC | beta Thalassemia |
| 34883338 | HBB | NM_000518.4(HBB): c.-50-92C>T | CCTCACCCTGTGGAGCYACACCC | |
| 35378915 | HBG1 | NM_000559.2(HBG1): c.-170G>A | CTTRACCAATAGCCTTGACAAGG | Fetal hemoglobin quantitative trait locus 1 |
| 35983258 | HBG1 | NM_000559.2(HBG1): c.-53-196C>T | CCTCTTGGGGGCCCCTTCYCCAC | Fetal hemoglobin quantitative trait locus 1 |
| 281860601 | HBG1 | NM_000559.2(HBG1): c.-167C>T | CCAGCCTTGCCTTGACYAATAGC | Fetal hemoglobin quantitative trait locus 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 34474104 | HBG2 | NM_000184.2(HBG2): c.190C>T (p.His64Tyr) | CCCCAAAGTCAAGGCAYATGGCA, CCAAAGTCAAGGCAYATGGCAAG | Cyanosis, transient neonatal |
| 35103459 | HBG2 | NM_000184.2(HBG2): c.277C>T (p.His93Tyr) | CCCAGCTGAGTGAACTGYACTGT, CCAGCTGAGTGAACTGYACTGTG | Cyanosis, transient neonatal |
| 587776864 | HBG2 | NM_000184.2(HBG2): c.202G>A (p.Val68Met) | CCCAAGGAAGTCAGCAYCTTCTT, CCAAGGAAGTCAGCAYCTTCTTG | Cyanosis, transient neonatal |
| 193929392 | HCCS | NM_005333.4(HCCS): c.475G>A (p.Glu159Lys) | GAATAACRAGCAGGCTTGGAAGG | Microphthalmia, syndromic, 7 |
| 318240758 | HCFC1 | NM_005334.2(HCFC1): c.674G>A (p.Ser225Asn) | GATGARTGGCTGCAGGCTGGGGG, GGATGARTGGCTGCAGGCTGGGG, GGGATGARTGGCTGCAGGCTGGG, CGGGATGARTGGCTGCAGGCTGG | Mental retardation 3, X-linked, not provided |
| 397515486 | HCFC1 | NM_005334.2(HCFC1): c.218C>T (p.Ala73Val) | CCAGTGGTTCATCCCAGYCGTGA | Mental retardation 3, X-linked |
| 398122909 | HDAC8 | NM_018486.2(HDAC8): c.958G>A (p.Gly320Arg) | ACTTGACCRGGGTCATCCTAGGG | Cornelia de Lange syndrome 5 |
| 387907052 | HEPACAM | NM_152722.4(HEPACAM): c.292C>T (p.Arg98Cys) | CCTGACTATCGAGACYGTATCCG | Megalencephalic leukoencephalopathy with subcortical cysts 2a |
| 104893742 | HESX1 | NM_003865.2(HESX1): c.445G>A (p.Glu149Lys) | TCTAGAGRAAGACAGAATCCAGG | Growth hormone deficiency with pituitary anomalies |
| 121907954 | HEXA | NM_000520.4(HEXA): c.805G>A (p.Gly269Ser) | ACCARGTAAGAATGATGTCTGGG, GACCARGTAAGAATGATGTCTGG | Tay-Sachs disease, Gm2-gangliosidosis, adult |
| 121907957 | HEXA | NM_000520.4(HEXA): c.509G>A (p.Arg170Gln) | TCCTCACCRGGGCTTGCTGTTGG | Tay-Sachs disease |
| 121907980 | HEXA | NM_000520.4(HEXA): c.805+1G>A | ACCAGRTAAGAATGATGTCTGGG, GACCAGRTAAGAATGATGTCTGG | |
| 1800429 | HEXA | NM_000520.4(HEXA): c.598G>A (p.Val200Met) | GAACRGTTCCACTGGCATCTGG | Tay-Sachs disease, B1 variant |
| 121907966 | HEXA | NM_000520.4(HEXA): c.1495C>T (p.Arg499Cys) | CCTGACATTTGCCTATGAAYGTT | Tay-Sachs disease, Gm2-gangliosidosis, adult-onset |
| 121907972 | HEXA | NM_000520.4(HEXA): c.508C>T (p.Arg170Trp) | CCCCGCTTTCCTCACYGGGGCTT, CCCGCTTTCCTCACYGGGGCTTG | Tay-Sachs disease |
| 76173977 | HEXA | NM_000520.4(HEXA): c.1073+1G>A | CCCTCCTTCCTTCCTCAYGTCTG, CCTCCTTCCTTCCTCAYGTCTGG | Tay-Sachs disease, not provided |
| 770932296 | HEXA | NM_000520.4(HEXA): c.806-7G>A | CCAGGGATACCTAAGCYAAGAGA | Tay-Sachs disease |
| 121907983 | HEXB | NM_000521.3(HEXB): c.1514G>A (p.Arg505Gln) | AGGCCTCRGGCAAGTGCTGTTGG | Sandhoff disease, adult type |
| 121907986 | HEXB | NM_000521.3(HEXB): c.850C>T (p.Arg284Ter) | CCAGATTACGAGGAATTYGAGTC | Sandhoff disease, Sandhoff disease, infantile |
| 1800562 | HFE | NM_000410.3(HFE): c.845G>A (p.Cys282Tyr) | ACGTRCCAGGTGGAGCACCCAGG | Hemochromatosis type 1, Microvascular complications of diabetes 7, Transferrin serum level quantitative trait locus 2, not specified, not provided |
| 587777269 | HFM1 | NM_001017975.4(HFM1): c.2206G>A (p.Gly736Ser) | CCAAGTCAAAGTAACAAACYATA | Premature ovarian failure 9 |
| 397515347 | HGD | NM_000187.3(HGD): c.16-1G>A | TACARTACATTTCTGGATTTGGG, CTACARTACATTTCTGGATTTGG | Alkaptonuria |
| 28942100 | HGD | NM_000187.3(HGD):688 c.688C>T (p.Pro230Ser) | CCTCGTGATTTCTTGATAYCCAT | Alkaptonuria |
| 398124544 | HGSNAT | NM_152419.2(HGSNAT): c.1250+1G>A | CTACRTAAGCGAACCCCTGGGGG, CCTACRTAAGCGAACCCCTGGGG, CCCTACRTAAGCGAACCCCTGGG, GCCCTACRTAAGCGAACCCCTGG | not provided |
| 112029032 | HGSNAT | NM_152419.2(HGSNAT): c.1843G>A (p.Ala615Thr) | CATCGTCRCCACTGCCCTCTGGG, ACATCGTCRCCACTGCCCTCTGG | Mucopolysaccharidosis, MPS-III-C, RETINITIS PIGMENTOSA 73 |
| 121908286 | HGSNAT | NM_152419.2(HGSNAT): c.1553C>T (p.Ser518Phe) | CCATTACAGGGGCTCATTTYTGT | Mucopolysaccharidosis, MPS-III-C |
| 397514493 | HINT1 | NM_005340.6(HINT1): c.278G>A (p.Gly93Asp) | GAATAAGGRTTATCGAATGGTGG | Gamstorp-Wohlfart syndrome |
| 397514492 | HINT1 | NM_005340.6(HINT1): c.184C>T (p.Gln62Ter) | CCCAAGAAACATATATCCYAGAT, CCAAGAAACATATATCCYAGATT | Gamstorp-Wohlfart syndrome |
| 146448211 | HLCS | NM_000411.6(HLCS): c.1993C>T (p.Arg665Ter) | AGTATCRGTAATAAAGGGGAAGG | not provided |
| 119103231 | HLCS | NM_000411.6(HLCS): c.1648G>A (p.Val550Met) | TGGCTGTCRTGGAAGCAGTGAGG | Holocarboxylase synthetase deficiency, not provided |
| 119103229 | HLCS | NM_000411.6(HLCS): c.1522C>T (p.Arg508Trp) | CCTGTGTTCCAGGAYGGGGAGGG | Holocarboxylase synthetase deficiency |
| 118204096 | HMBS | NM_000190.3(HMBS): c.518G>A (p.Arg173Gln) | CAACACCCRGCTTCGGAAGCTGG | Acute intermittent porphyria |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118204100 | HMBS | NM_000190.3(HMBS): c.593G>A (p.Trp198Ter) | TGGGCTRGCACAACCGGGTGGGG, ATGGGCTRGCACAACCGGGTGGG, CATGGGCTRGCACAACCGGGTGG | Acute intermittent porphyria |
| 118204103 | HMBS | NM_000190.3(HMBS): c.77G>A (p.Arg26His) | GGTACCCRCAAGAGCCAGGTGGG, GGGTACCCRCAAGAGCCAGGTGG | Acute intermittent porphyria |
| 118204104 | HMBS | NM_000190.3(HMBS): c.91G>A (p.Ala31Thr) | GCAGCTTRCTCGCATACAGACGG | Acute intermittent porphyria |
| 118204110 | HMBS | NM_000190.3(HMBS): c.667G>A (p.Glu223Lys) | GGGCGTGRAAGTGCGAGCCAAGG | Acute intermittent porphyria |
| 118204112 | HMBS | NM_000190.3(HMBS): c.748G>A (p.Glu250Lys) | TCGCTRAAAGGGCCTTCCTGAGG | Acute intermittent porphyria |
| 118204113 | HMBS | NM_000190.3(HMBS): c.754G>A (p.Ala252Thr) | AAGGRCCTTCCTGAGGCACCTGG | Acute intermittent porphyria |
| 118204116 | HMBS | NM_000190.3(HMBS): c.647G>A (p.Gly216Asp) | TGGRCCAGGTACACTTGACCAGG | Acute intermittent porphyria |
| 118204094 | HMBS | NM_000190.3(HMBS): c.346C>T (p.Arg116Trp) | CCTTCCCTCCTCCCCAGGYGGG, CCCTCCTCCCCAGGYGGGAAAA, CCTCCTCCCCAGGYGGGAAAAC | Acute intermittent porphyria |
| 118204101 | HMBS | NM_000190.3(HMBS): c.499C>T (p.Arg167Trp) | CCTTAGCAACTCTCCACAGYGGG | Acute intermittent porphyria |
| 28937320 | HMGCS2 | NM_001166107.1(HMGCS2): c.160G>A (p.Val54Met) | GGACRTGGGCATCCTGGCCCTGG | mitochondrial 3-hydroxy-3-methylglutaryl-CoA synthase deficiency |
| 137852639 | HMGCS2 | NM_001166107.1(HMGCS2): c.1373G>A (p.Arg458His) | AGCATCRCCGAAAGTATGCCCGG | mitochondrial 3-hydroxy-3-methylglutaryl-CoA synthase deficiency |
| 137853238 | HNF1A | NM_000545.6(HNF1A): c.815G>A (p.Arg272His) | GGCRCAAAGAAGAAGCCTTCCGG | Diabetes mellitus, insulin-dependent, 20 |
| 137853241 | HNF1A | NM_000545.6(HNF1A): c.1859C>T (p.Thr620Ile) | CCACAGCGTCATCGAGAYCTTCA | Maturity-onset diabetes of the young, type 3 |
| 137853243 | HNF1A | NM_000545.6(HNF1A): c.335C>T (p.Pro112Leu) | CCCTCTCCCAGGGAGGACCYGTG, CCTCTCCCAGGGAGGACCYGTGG | Maturity-onset diabetes of the young, type 3 |
| 121918675 | HNF1B | NM_000458.3(HNF1B): c.494G>A (p.Arg165His) | AGCRTGCCGCTCTGTACACCTGG | Familial hypoplastic, glomerulocystic kidney |
| 137853336 | HNF4A | NM_000457.4(HNF4A): c.406C>T (p.Arg136Trp) | CCAGAATGAGCGGGACYGGATCA | Maturity-onset diabetes of the young, type 1 |
| 777046879 | HOGA1 | NM_138413.3(HOGA1): c.973G>A (p.Gly325Ser) | CAACRGCTGGCTCTGAGGGCAGG, CCAGCAACRGCTGGCTCTGAGGG | Primary hyperoxaluria, type III |
| 764396564 | HOGA1 | NM_138413.3(HOGA1): c.134C>T (p.Pro45Leu) | CCCCCCTGTGACCACCCYCTTCA, CCCCTGTGACCACCCYCTTCAC, CCCTGTGACCACCCYCTTCACT, CCTGTGACCACCCYCTTCACTG | Primary hyperoxaluria, type III |
| 104894019 | HOXA13 | NM_000522.4(HOXA13): c.1107G>A (p.Trp369Ter) | AATCTGRTTCCAGAACAGGAGGG, CAATCTGRTTCCAGAACAGGAGG | Hand foot uterus syndrome |
| 550921485 | HPCA | NM_002143.2(HPCA): c.568G>A (p.Ala190Thr) | CAGCRCCTCCCAGTTCTGAGAGG | Dystonia 2, torsion, autosomal recessive |
| 398123240 | HPRT1 | NM_000194.2(HPRT1): c.384+1G>A | GAAAGRTATGTATCTTGAAAGGG, GGAAAGRTATGTATCTTGAAAGG | not provided |
| 398123241 | HPRT1 | NM_000194.2(HPRT1): c.486-1G>A | TTAACARCTTGCTGGTGAAAAGG | not provided |
| 137852506 | HPRT1 | NM_000194.2(HPRT1): c.193C>T (p.Leu65Phe) | CCATCACATTGTAGCCYTCTGTG | Partial hypoxanthine-guanine phosphoribosyltransferase deficiency |
| 281865089 | HPS1 | NM_000195.4(HPS1): c.1749G>A (p.Trp583Ter) | CCAGCTGGATCAGAGAYCAGACC | Hermansky-Pudlak syndrome 1 |
| 121908316 | HPS3 | NM_032383.4(HPS3): c.1189C>T (p.Arg397Trp) | CCTGCAGTGTTTCACTGTGYGGT | Hermansky-Pudlak syndrome 3 |
| 119471023 | HPS4 | NM_022081.5(HPS4): c.649C>T (p.Arg217Ter) | CCAAGGTCCTGCTTCACYGAACA | Hermansky-Pudlak syndrome 4 |
| 281865107 | HPS6 | NM_024747.5(HPS6): c.223C>T (p.Gln75Ter) | GGAGGGCTRGCCGGCCGGCCAGG | Hermansky-Pudlak syndrome 6 |
| 281865109 | HPS6 | NM_024747.5(HPS6): c.815C>T (p.Thr272Ile) | GCCCAGRTGTGTACAGCCAGTGG | Hermansky-Pudlak syndrome 6 |
| 281865112 | HPS6 | NM_024747.5(HPS6): c.1234C>T (p.Gln412Ter) | CCGCCGCTRGTAGTACCCGCAGG | Hermansky-Pudlak syndrome 6 |
| 121434451 | HR | NM_005144.4(HR): c.3034G>A (p.Asp1012Asn) | GGCCRACCTGGTCAGCATCCTGG | Alopecia universalis congenita |
| 121917780 | HSD11B2 | NM_000196.3(HSD11B2): c.622C>T (p.Arg208Cys) | CCTCCTGCCCCTGCTGYGCAGCT | Apparent mineralocorticoid excess |
| 28935475 | HSD17B10 | NM_001037811.2 (HSD17B10):c.388C>T (p.Arg130Cys) | CCTTCAATGTGATCYGCCTGGTG | 2-methyl-3-hydroxybutyric aciduria |
| 119481078 | HSD17B3 | NM_000197.1(HSD17B3): c.166G>A (p.Ala56Thr) | CTGGARCAGGCGATGGAATTGGG, ACTGGARCAGGCGATGGAATTGG | Testosterone 17-beta-dehydrogenase deficiency |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28939085 | HSD17B3 | NM_000197.1(HSD17B3): c.695C>T (p.Ser232Leu) | CCCCATATGCTGTCTYGACTGCA, CCCATATGCTGTCTYGACTGCAA | Testosterone 17-beta-dehydrogenase deficiency |
| 80358216 | HSD3B2 | NM_001166120.1(HSD3B2): c.512G>A (p.Trp171Ter) | AATGGGTRGAATCTAAAAAATGG | 3 beta-Hydroxysteroid dehydrogenase deficiency |
| 28937569 | HSPB1 | NM_001540.3(HSPB1): c.545C>T (p.Pro182Leu) | CCAACGAGATCACCATCCYAGTC | Distal hereditary motor neuronopathy type 2B |
| 104894020 | HSPB1 | NM_001540.3(HSPB1): c.544C>T (p.Pro182Ser) | CCAACGAGATCACCATCYCAGTC | Distal hereditary motor neuronopathy type 2B |
| 29001571 | HSPB1 | NM_001540.3(HSPB1): c.379C>T (p.Arg127Trp) | CCGGCAAGCACGAGGAGYGGCAG | Charcot-Marie-Tooth disease type 2F, Distal hereditary motor neuronopathy type 2B |
| 137853248 | HSPG2 | NM_005529.6(HSPG2): c.4595G>A (p.Cys1532Tyr) | CGCTRCCCGCCAGGCTACATCGG | Schwartz Jampel syndrome type 1 |
| 587776445 | HTRA1 | NM_002775.4(HTRA1): c.821G>A (p.Arg274Gln) | GCTGCRGCCGGGAGAGTTCGTGG | Cerebral autosomal recessive arteriopathy with subcortical infarcts and leukoencephalopathy |
| 113993969 | HTRA1 | NM_002775.4(HTRA1): c.889G>A (p.Val297Met) | ATCRTGAGCACCACCCAGCGAGG | Cerebral autosomal recessive arteriopathy with subcortical infarcts and leukoencephalopathy |
| 113993971 | HTRA1 | NM_002775.4(HTRA1): c.1108C>T (p.Arg370Ter) | CCTCACGGAGTCCCATGACYGAC | Cerebral autosomal recessive arteriopathy with subcortical infarcts and leukoencephalopathy |
| 104893743 | HYAL1 | NM_153281.1(HYAL1): c.802G>A (p.Glu268Lys) | TGTGGCCRAGGCATTCCGTGTGG | Deficiency of hyaluronoglucosaminidase |
| 373436822 | IARS2 | NM_018060.3(IARS2): c.1821G>A (p.Trp607Ter) | TCATGRTCTTATGTTCTTCCAGG | Leigh disease, not provided |
| 118203918 | ICK | NM_016513.4(ICK): c.815G>A (p.Arg272Gln) | GAAACRACCAACAGCTAGTCAGG | Endocrine-cerebroosteodysplasia |
| 121913500 | IDH1 | NM_001282386.1(IDH1): c.395G>A (p.Arg132His) | CATAGGTCRTCATGCTTATGGGG | |
| 121913502 | IDH2 | NM_002168.3(IDH2): c.419G>A (p.Arg140Gln) | CTATCCRGAACATCCTGGGGGGG, ACTATCCRGAACATCCTGGGGGG, AACTATCCRGAACATCCTGGGGG | D-2-hydroxyglutaric aciduria 2 |
| 104894853 | IDS | NM_000202.6(IDS): c.998C>T (p.Ser333Leu) | CCATCATTGCATTTACCTYGGAT | Mucopolysaccharidosis, MPS-II, not provided |
| 199422231 | IDS | NM_000202.6(IDS): c.1402C>T (p.Arg468Trp) | CCTATAGCCAGTATCCCYGGCCT | Mucopolysaccharidosis, MPS-II |
| 121965019 | IDUA | NM_000203.4(IDUA): c.1205G>A (p.Trp402Ter) | GCTCTRGGCCGAAGTGTCGCAGG | Hurler syndrome, not provided |
| 121965030 | IDUA | NM_000203.4(IDUA): c.898G>A (p.Ala300Thr) | GACGAGRCGGACCCGCTGGTGGG, CGACGAGRCGGACCCGCTGGTGG | |
| 121965032 | IDUA | NM_000203.4(IDUA): c.1091C>T (p.Thr364Met) | CCCCTTCGCGCAGCGCAYGCTCA, CCCTTCGCGCAGCGCAYGCTCAC, CCTTCGCGCAGCGCAYGCTCACC | Mucopolysaccharidosis, MPS-I-H/S |
| 786201032 | IFITM5 | NM_001025295.2(IFITM5): c.119C>T (p.Ser40Leu) | CCACTTGATCTGGTYGGTGTTCA | Osteogenesis imperfecta type 5 |
| 431905521 | IF1140 | NM_014714.3(IFT140): c.874G>A (p.Val292Met) | TCTCRTGATGGCCGTCGGGGAGG, CCTTCTCRTGATGGCCGTCGGGG, GCCTTCTCRTGATGGCCGTCGGG | Renal dysplasia, retinal pigmentary dystrophy, cerebellar ataxia and skeletal dysplasia |
| 794727473 | IF1140 | NM_014714.3(IFT140): c.3991C>T (p.Gln1331Ter) | CCAGGAGACCAGGCTGGCGYAGC | Renal dysplasia, retinal pigmentary dystrophy, cerebellar ataxia and skeletal dysplasia |
| 199826737 | IFT140 | NM_014714.3(IFT140): c.1565G>A (p.Gly522Glu) | CCAAGAAGCAGGGATTCYCCTCA | |
| 201188361 | IF1140 | NM_014714.3(IFT140): c.634G>A (p.Gly212Arg) | CCAAAGTTCCTCACYGTCCATCA | Renal dysplasia, retinal pigmentary dystrophy, cerebellar ataxia and skeletal dysplasia |
| 145541911 | IFT172 | NM_015662.2(IFT172): c.886C>T (p.Arg296Trp) | GCCATCCCRCTTCCAGGCCAAGG | |
| 587777546 | IF127 | NM_001177701.2(IFT27): c.299G>A (p.Cys100Tyr) | CCAGCCACTTGCTGYAGTTGTTG | Bardet-Biedl syndrome 19 |
| 137852667 | IGHMBP2 | NM_002180.2(IGHMBP2): c.1738G>A (p.Val580Ile) | TTCRTCAGATCCAACAGGAAAGG, TGTCCTTCRTCAGATCCAACAGG | Werdnig-Hoffmann disease, Charcot-Marie-Tooth disease |
| 74315491 | IGLL1 | NM_020070.3(IGLL1): c.64C>T (p.Gln22Ter) | CCAGGCCCAACCTCAGGYAGCG | Agammaglobulinemia 2, autosomal recessive |
| 121917853 | IHH | NM_002181.3(IHH): c.391G>A (p.Glu131Lys) | ACCRAGGGCTGGGACGAGGACGA, GGTGACCRAGGGCTGGGACGAGG | Brachydactyly type A1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121917855 | IHH | NM_002181.3(IHH): c.298G>A (p.Asp100Asn) | CGCCRACCGCCTCATGACCCAGG | Brachydactyly type A1 |
| 267606873 | IHH | NM_002181.3(IHH): c.383G>A (p.Arg128Gln) | GCTGCRGGTGACCGAGGGCTGGG, AGCTGCRGGTGACCGAGGGCTGG | Brachydactyly type A1 |
| 121917861 | IHH | NM_002181.3(IHH): c.461C>T (p.Thr154Ile) | CCGCGCGGTGGACATCAYCACAT | Brachydactyly type A1 |
| 121917856 | IHH | NM_002181.3(IHH): c.137C>T (p.Pro46Leu) | CCGCCACGCAAACTCGTGCYGCT, CCACGCAAACTCGTGCYGCTCGC | Acrocapitofemoral dysplasia |
| 200296680 | IKBKB | NM_001556.2(IKBKB): c.814C>T (p.Arg272Ter) | CCACAGTGTCCTGGCTGAGYGAC | Immunodeficiency 15 |
| 137853329 | IKBKG | NM_003639.4(IKBKG): c.1207C>T (p.Gln403Ter) | CCCAAGTGCCAGTATYAGGCCCC, CCAAGTGCCAGTATYAGGCCCCT | Hypohidrotic ectodermal dysplasia with immune deficiency |
| 149491038 | IL10RA | NM_001558.3(IL10RA): c.784C>T (p.Arg262Cys) | CCTCCAGCTGTATGTGCGGYGCC, CCAGCTGTATGTGCGGYGCCGAA | |
| 137853580 | IL10RA | NM_001558.3(IL10RA): c.251C>T (p.Thr84Ile) | CCCTGTCCTATGACCTTAYCGCA, CCTGTCCTATGACCTTAYCGCAG | |
| 387906787 | IL11RA | NM_001142784.2(IL11RA): c.475C>T (p.Gln159Ter) | CCTAGGAGCTGATAGCYAGAGGT | Craniosynostosis and dental anomalies |
| 121434492 | IL12RB1 | NM_005535.2(IL12RB1): c.94C>T (p.Gln32Ter) | CCAGTGAGTGCTGTTTTYAGGAC | Immunodeficiency 30 |
| 748486078 | IL17F | NM_052872.3(IL17F): c.284C>T (p.Ser95Leu) | CTTCCRAGGGGTACCGGTTGGGG, ACTTCCRAGGGGTACCGGTTGGG, AACTTCCRAGGGGTACCGGTTGG | Candidiasis, familial, 6 |
| 387906913 | IL17RA | NM_014339.6(IL17RA): c.850C>T (p.Gln284Ter) | CCCTCTCTGCCCGCAGATCYAGC, CCTCTCTGCCCGCAGATCYAGCC | Candidiasis, familial, 5 |
| 122461161 | IL1RAPL1 | NM_014271.3(IL1RAPL1): c.1460G>A (p.Trp487Ter) | GGGCTRGAGCATCTTTGAGCTGG | Mental retardation 21, X-linked |
| 137852508 | IL2RG | NM_000206.2(IL2RG): c.865C>T (p.Arg289Ter) | CCCTGTCAGGACGATGCCCYGAA, CCTGTCAGGACGATGCCCYGAAT | X-linked severe combined immunodeficiency |
| 104893894 | IL7R | NM_002185.3(IL7R): c.394C>T (p.Pro132Ser) | CCAGTTAAACCTGAGGCTYCTTT | Severe combined immunodeficiency, autosomal recessive, T cell-negative, B cell-positive, NK cell-positive |
| 121912551 | IMPDH1 | NM_000883.3(IMPDH1): c.1057G>A (p.Val353Ile) | GGGCRTCGACGTCATAGTCTTGG | Retinitis pigmentosa 10 |
| 121912553 | IMPDH1 | NM_000883.3(IMPDH1): c.568C>T (p.Arg190Trp) | CCAGGCCAACGAGGTGYGGAAGG | Leber congenital amaurosis 11 |
| 267607183 | INF2 | NM_022489.3(INF2): c.653G>A (p.Arg218Gln) | CAGCTGCRGAACGAGTTTATCGG | Focal segmental glomerulosclerosis 5 |
| 121918129 | INPP5E | NM_019892.4(INPP5E): c.1304G>A (p.Arg435Gln) | AGCRGCTGCTGGACTACACCAGG | Familial aplasia of the vermis, Joubert syndrome 1 |
| 104894698 | INSL3 | NM_005543.3(INSL3): c.304C>T (p.Arg102Cys) | CCAGACCTCTCACCATCACYGCC, CCTCTCACCATCACYGCCACCAC | Cryptorchidism, unilateral or bilateral |
| 121913139 | INSR | NM_000208.2(INSR): c.3481G>A (p.Ala1161Thr) | CCTGCRAGCGAGAAACTGCATGG | Insulin resistance, Insulin-resistant diabetes mellitus AND acanthosis nigricans |
| 121913146 | INSR | NM_000208.2(INSR): c.479G>A (p.Trp160Ter) | TATCGACTRGTCCCGTATCCTGG | Insulin-resistant diabetes mellitus AND acanthosis nigricans |
| 121913150 | INSR | NM_000208.2(INSR): c.3572G>A (p.Arg1191Gln) | TACTACCRGAAAGGGGCAAGGG, TTACTACCRGAAAGGGGCAAGG | Diabetes mellitus type 2 |
| 121913156 | INSR | NM_000208.2(INSR): c.3602G>A (p.Arg1201Gln) | CCCTGTACRGTGGATGGCACCGG | Insulin-resistant diabetes mellitus AND acanthosis nigricans, Hyperinsulinemic hypoglycemia familial 5 |
| 1799816 | INSR | NM_000208.2(INSR): c.3034G>A (p.Val1012Met) | GTACRTGCCGGACGAGTGGGAGG, TGTGTACRTGCCGGACGAGTGGG, CTGTGTACRTGCCGGACGAGTGG | Diabetes mellitus type 2, not specified |
| 755549444 | INVS | NM_014425.3(INVS): c.2509C>T (p.Gln837Ter) | CCAAGAAACAAAGTGACAYAAGC | Infantile nephronophthisis |
| 121918244 | IQCB1 | NM_001023570.2(IQCB1): c.1381C>T (p.Arg461Ter) | CCGAGTTGAACTGAAGAAAYGAG | Senior-Loken syndrome 5, not provided |
| 727503968 | IQCB1 | NM_001023570.2(IQCB1): c.1090C>T (p.Arg364Ter) | CCATGAGACTTTCCYGAGAATTG | Senior-Loken syndrome 5, not provided |
| 587777261 | IQSEC2 | NM_001111125.2(IQSEC2): c.2563C>T (p.Arg855Ter) | GATGAGTCRCTCCACTTTCTGGG | Mental retardation, X-linked, nonspecific |
| 267607186 | IQSEC2 | NM_001111125.2(IQSEC2): c.2587C>T (p.Arg863Trp) | CCTCCTGCCCTGCAGCCAGYGGT, CCTGCCCTGCAGCCAGYGGTACT | Mental retardation, X-linked, nonspecific, not provided |
| 267607188 | IQSEC2 | NM_001111125.2(IQSEC2): c.1075C>T (p.Arg359Cys) | CCATCCAGACAGCCTTCYGCCAG | Mental retardation, X-linked, nonspecific |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 377584435 | IRAK4 | NM_016123.3(IRAK4): c.34C>T (p.Arg12Cys) | CCATCAACATATGTGYGCTGCCT | IRAK4 deficiency |
| 121434228 | IRF6 | NM_006147.3(IRF6): c.1137G>A (p.Trp379Ter) | ATGRCCAGATGGGAAACCATTGG | Van der Woude syndrome |
| 397515434 | IRF6 | NM_006147.3(IRF6): c.145C>T (p.Gln49Ter) | CCACCCGGCATAGCCCYAACAA, CCCGGCATAGCCCYAACAAGAA | Van der Woude syndrome |
| 28942093 | IRF6 | NM_006147.3(IRF6): c.5C>T (p.Ala2Val) | CCCCCCCAGATCATGGYCCTCCA, CCCCCCAGATCATGGYCCTCCAC, CCCCCAGATCATGGYCCTCCACC | Van der Woude syndrome |
| 121434230 | IRF6 | NM_006147.3(IRF6): c.1186C>T (p.Pro396Ser) | CCTGAACAGGTCATTYCAGTAGT | Van der Woude syndrome |
| 387906968 | IRF6 | NM_006147.3(IRF6): c.1271C>T (p.Ser424Leu) | CCGCCTGCAGATCTYAACCCCAG | Popliteal pterygium syndrome |
| 786201005 | ISG15 | NM_005101.3(ISG15): c.163C>T (p.Gln55Ter) | CCCGAGCGGTGTGGCGCTGYAGG, CCGAGCGGTGTGGCGCTGYAGGA | Immunodeficiency 38 |
| 368593151 | ISPD | NM_001101426.3(ISPD): c.802C>T (p.Arg268Ter) | CTCRTTTGTAGGTCACCTAAAGG | Congenital muscular dystrophy-dystroglycanopathy with brain and eye anomalies, type A7 |
| 137852907 | ITGA2B | NM_000419.3(ITGA2B): c.818G>A (p.Gly273Asp) | GGCCGTGGRCGAGTTCGACGGGG | Glanzmann thrombasthenia |
| 137852906 | ITGA2B | NM_000419.3(ITGA2B): c.1750C>T (p.Arg584Ter) | CCACCATGGCCTTCCTTYGAGTA, CCATGGCCTTCCTTYGAGTACGC | Glanzmann thrombasthenia |
| 200402328 | ITGA7 | NM_002206.2(ITGA7): c.2357+1G>A | CCGGCCCCGCCTGGCTTAYGTGG, CCCCGCCTGGCTTAYGTGGCCAA | Congenital muscular dystrophy |
| 374664941 | ITGA8 | NM_003638.2(ITGA8): c.1219G>A (p.Gly407Arg) | CCTGCAAAAGGCACTCYGATGGC | Renal adysplasia |
| 9983887 | ITGB2 | NM_000211.4(ITGB2): c.329-6C>T | GCCRGTGGGACAGAACAAAAGG | Leukocyte adhesion deficiency type 1 |
| 137852616 | ITGB2 | NM_000211.4(ITGB2): c.850G>A (p.Gly284Ser) | CGACRGCCGCTGTCACCTGGAGG, CAACGACRGCCGCTGTCACCTGG | Leukocyte adhesion deficiency |
| 121918449 | ITGB3 | NM_000212.2(ITGB3): c.1199G>A (p.Cys400Tyr) | TGCCACCTRCCTCAACAATGAGG | Glanzmann thrombasthenia |
| 121912466 | ITGB4 | NM_000213.3(ITGB4): c.2792G>A (p.Gly931Asp) | CCGGGRCATGGTGGAGTTCCAGG | Adult junctional epidermolysis bullosa |
| 80338755 | ITGB4 | NM_000213.3(ITGB4): c.182G>A (p.Cys61Tyr) | CCGGCGCTRCAACACCCAGGCGG | Epidermolysis bullosa with pyloric atresia |
| 121912462 | ITGB4 | NM_000213.3(ITGB4): c.1660C>T (p.Arg554Ter) | CCCTCTCTGCAGACYGAGGACGC | Epidermolysis bullosa with pyloric atresia |
| 121908191 | ITK | NM_005546.3(ITK): c.1003C>T (p.Arg335Trp) | CCTGGTGACTCGACTCYGGTATC | Lymphoproliferative syndrome 1 |
| 763471771 | IVD | NM_002225.3(IVD): c.793+1G>A | GATTCCTGRTAAGTAGCACCGGG | Isovaleryl-CoA dehydrogenase deficiency |
| 28940889 | IVD | NM_002225.3(IVD): c.941C>T (p.Ala314Val) | CCTGCACGTGAGGGAAGYCTTTG | Isovaleryl-CoA dehydrogenase deficiency, not provided |
| 28939668 | JAG1 | NM_000214.2(JAG1): c.821G>A (p.Gly274Asp) | ACGRCATCTGTAATGAGCCCTGG | Tetralogy of Fallot |
| 121918350 | JAG1 | NM_000214.2(JAG1): c.550C>T (p.Arg184Cys) | CCACTTTGAGTATCAGATCYGCG | Alagille syndrome 1 |
| 587777727 | JAGN1 | NM_032492.3(JAGN1): c.3G>A (p.Met1Ile) | GGCACAATRGCGTCTCGAGCAGG | Severe congenital neutropenia, Severe congenital neutropenia 6, autosomal recessive |
| 137852626 | JAK3 | NM_000215.3(JAK3): c.1333C>T (p.Arg445Ter) | CCTTCTGGTTGGCCTCAGCYGAC | Severe combined immunodeficiency, autosomal recessive, T cell-negative, B cell-positive, NK cell-negative |
| 796052595 | KANSL1 | NM_001193466.1(KANSL1): c.2203+1G>A | CCARTAAGTGTCAGGGAGCCGGG, GCCARTAAGTGTCAGGGAGCCGG | not provided |
| 397514746 | KARS | NM_001130089.1(KARS): c.1129G>A (p.Asp377Asn) | TCACRATCTCATGGAAATCACGG | Deafness, autosomal recessive 89 |
| 730880257 | KATNB1 | NM_005886.2(KATNB1): c.1604C>T (p.Ser535Leu) | CCATCAACGACCTGTYGGTGGTG | Lissencephaly 6, with microcephaly |
| 786205232 | KCNA2 | NM_004974.3(KCNA2): c.890G>A (p.Arg297Gln) | TCCRGTTGGTAAGAGTCTTTAGG | EPILEPTIC ENCEPHALOPATHY, EARLY INFANTILE, 32 |
| 121908593 | KCNA5 | NM_002234.3(KCNA5): c.1828G>A (p.Glu610Lys) | CCGGRAAACAGATTTGTGAAAGG | Atrial fibrillation, familial, 7 |
| 1805128 | KCNE1 | NM_000219.5(KCNE1): c.253G>A (p.Asp85Asn) | GTCCRATGCCTGGCAAGAGAAGG | Long QT syndrome, Long QT syndrome 5, acquired, susceptibility to, Long QT syndrome 2/5, not specified, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473360 | KCNE1 | NM_000219.5(KCNE1): c.247G>A (p.Glu83Lys) | TCTACATCRAGTCCGATGCCTGG | Congenital long QT syndrome |
| 199473644 | KCNE1 | NM_000219.5(KCNE1): c.163G>A (p.Gly55Ser) | TTCTTCRGCTTCTTCACCCTGGG, ATTCTTCRGCTTCTTCACCCTGG | Congenital long QT syndrome, not specified |
| 79654911 | KCNE1 | NM_000219.5(KCNE1): c.200G>A (p.Arg67His) | CCAGCTTCTTGGAGYGGATGTAG | Long QT syndrome, Congenital long QT syndrome |
| 74315446 | KCNE1 | NM_000219.5(KCNE1): c.221C>T (p.Ser74Leu) | CCAAGAAGCTGGAGCACTYGAAC | Long QT syndrome 5, Congenital long QT syndrome |
| 28933384 | KCNE1 | NM_000219.5(KCNE1): c.20C>T (p.Thr7Ile) | CCTGTCTAACACCAYAGCGGTGA | Jervell and Lange-Nielsen syndrome 2, Congenital long QT syndrome |
| 199473367 | KCNE2 | NM_172201.1(KCNE2): c.347C>T (p.Ala116Val) | CCATGAGAACATTGGTGYGGCTG | Acquired long QT syndrome |
| 199473648 | KCNE2 | NM_172201.1(KCNE2): c.29C>T (p.Thr10Met) | CCAATTTCACACAGAYGCTGGAA | Long QT syndrome, Congenital long QT syndrome, Cardiac arrhythmia |
| 730882174 | KCNH1 | NM_002238.3(KCNH1): c.1042G>A (p.Gly348Arg) | TGAATATRGAGCTGCTGTGCTGG | Zimmermann-Laband syndrome |
| 794728397 | KCNH2 | NM_000238.3(KCNH2): c.2770G>A (p.Gly924Arg) | CCGGCCGRGGGGCCGTGGGGGG, GCCGGCCGRGGGGCCGTGGGGG | Cardiac arrhythmia |
| 794728401 | KCNH2 | NM_000238.3(KCNH2): c.3002G>A (p.Trp1001Ter) | AGCTTCTRGGGGACAGTCGGGG, CAGCTTCTRGGGGACAGTCGGG | Cardiac arrhythmia |
| 794728478 | KCNH2 | NM_000238.3(KCNH2): c.1129-1G>A | CGGGTGCARGTCCTGTCCCTGGG | Cardiac arrhythmia |
| 794728487 | KCNH2 | NM_000238.3(KCNH2): c.1945+1G>A | GCTRTGAGTGTGCCCAGGGGCGG, TTGGCTRTGAGTGTGCCCAGGGG, ATTGGCTRTGAGTGTGCCCAGGG, CATTGGCTRTGAGTGTGCCCAGG | Cardiac arrhythmia |
| 141401803 | KCNH2 | NM_000238.3(KCNH2): c.2860C>T (p.Arg954Cys) | GGCRGAGGGGGCTGGAGCTGCGG | Sudden infant death syndrome, Cardiac arrhythmia |
| 199472880 | KCNH2 | NM_000238.3(KCNH2): c.865G>A (p.Glu289Lys) | CATCRAGGCCATGCGCGCCGGGG, ACATCRAGGCCATGCGCGCCGGG, GACATCRAGGCCATGCGCGCCGG | Congenital long QT syndrome |
| 199472937 | KCNH2 | NM_000238.3(KCNH2): c.1811G>A (p.Gly604Asp) | CCTGGGCGDCCCCTCCATCAAGG | Congenital long QT syndrome |
| 199473019 | KCNH2 | NM_000238.3(KCNH2): c.3014G>A (p.Arg1005Gln) | CAGTCRGGGCCGCCAGTACCAGG | Congenital long QT syndrome |
| 199473022 | KCNH2 | NM_000238.3(KCNH2): c.3107G>A (p.Gly1036Asp) | CCCGGGRCGACGTGGAGAGCAGG | Congenital long QT syndrome, Cardiac arrhythmia |
| 199473432 | KCNH2 | NM_000238.3(KCNH2): c.2660G>A (p.Arg887His) | AGCRCAAGTTGTCCTTCCGCAGG | Long QT syndrome, Congenital long QT syndrome |
| 199473540 | KCNH2 | NM_000238.3(KCNH2): c.2810G>A (p.Ser937Asn) | CTCCARCCCTGAGAGCAGTGAGG | Congenital long QT syndrome, Cardiac arrhythmia |
| 199473669 | KCNH2 | NM_000238.3(KCNH2): c.2707G>A (p.Gly903Arg) | CCARGGGAGGTGTCGGCCTTGGG, GCCARGGGAGGTGTCGGCCTTGG | Congenital long QT syndrome, Cardiac arrhythmia |
| 199473670 | KCNH2 | NM_000238.3(KCNH2): c.2759G>A (p.Arg920Gln) | GTAGCCRGGGCCGGCCGGGGGGG, AGTAGCCRGGGCCGGCCGGGGGG, GAGTAGCCRGGGCCGGCCGGGGG | Congenital long QT syndrome |
| 121912509 | KCNH2 | NM_000238.3(KCNH2): c.3003G>A (p.Trp1001Ter) | AGCTTCTGRGGGGACAGTCGGGG | Long QT syndrome 2, Cardiac arrhythmia |
| 138498207 | KCNH2 | NM_000238.3(KCNH2): c.2371C>T (p.Arg791Trp) | GTCGCCCCRCAGGATCTCGATGG | Long QT syndrome, Congenital long QT syndrome, Cardiac arrhythmia |
| 770047651 | KCNH2 | NM_000238.3(KCNH2): c.1128G>A (p.Gln376=) | CCGGCCGCTGGGCGCCTACYTGG, CCGCTGGGCGCCTACYTGGGTGA | Long QT syndrome, Cardiac arrhythmia |
| 794728381 | KCNH2 | NM_000238.3(KCNH2): c.2026C>T (p.Gln676Ter) | CCCGCTACCACACAYAGATGCTG | Cardiac arrhythmia |
| 794728403 | KCNH2 | NM_000238.3(KCNH2): c.3040C>T (p.Arg1014Ter) | CCAGTACCAGGAGCTCCCTYGAT | Cardiac arrhythmia |
| 794728364 | KCNH2 | NM_000238.3(KCNH2): c.1096C>T (p.Arg366Ter) | CCTAAGATAAAGGAGYGAACCCA | Cardiac arrhythmia |
| 794728481 | KCNH2 | NM_000238.3(KCNH2): c.1684C>T (p.His562Tyr) | CCTTTGCGCTCATCGCGYACTGG | Cardiac arrhythmia |
| 199472885 | KCNH2 | NM_000238.3(KCNH2): c.934C>T (p.Arg312Cys) | CCATGCACCCACTGYGCAGCGGC | Long QT syndrome, Congenital long QT syndrome, Cardiac arrhythmia |
| 199472901 | KCNH2 | NM_000238.3(KCNH2): c.1307C>T (p.Thr436Met) | CCTTCCTGCTGAAGGAGAYGGAA, CCTGCTGAAGGAGAYGGAAGAG | Congenital long QT syndrome |
| 199472910 | KCNH2 | NM_000238.3(KCNH2): c.1474C>T (p.His492Tyr) | CCCCGGCCGCATCGCCGTCYACT, CCCGGCCGCATCGCCGTCYACTA, CCGGCCGCATCGCCGTCYACTAC | Congenital long QT syndrome |
| 199472984 | KCNH2 | NM_000238.3(KCNH2): c.2086C>T (p.Arg696Cys) | CCCCAATCCCCTGCGCCAGYGCC, CCCAATCCCCTGCGCCAGYGCCT, CCAATCCCCTGCGCCAGYGCCTC | Congenital long QT syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473021 | KCNH2 | NM_000238.3(KCNH2): c.3097C>T (p.Arg1033Trp) | CCTCTCCAGCCCGGGTCGGYGGC, CCAGCCCGGGTCGGYGGCCCCGG | Congenital long QT syndrome |
| 199473035 | KCNH2 | NM_000238.3(KCNH2): c.3457C>T (p.His1153Tyr) | CCCCAGCCCCTGCACAGAYACGGC, CCAGCCCCTGCACAGAYACGGCT | Congenital long QT syndrome |
| 121912504 | KCNH2 | NM_000238.3(KCNH2): c.1682C>T (p.Ala561Val) | CCTTTGCGCTCATCGYGCACTGG | Long QT syndrome 2, Congenital long QT syndrome, Cardiac arrhythmia |
| 121912508 | KCNH2 | NM_000238.3(KCNH2): c.1744C>T (p.Arg582Cys) | CCACACATGGACTCAYGCATCGG | Long QT syndrome 2, Congenital long QT syndrome, Cardiac arrhythmia |
| 794728382 | KCNH2 | NM_000238.3(KCNH2): c.2104C>T (p.Gln702Ter) | CCTCGAGGAGTACTTCYAGCACG | Cardiac arrhythmia |
| 150988911 | KCNH2 | NM_000238.3(KCNH2): c.343G>A (p.Val115Met) | CCCCATCCTCGTTCTTCAYGGGC, CCCATCCTCGTTCTTCAYGGGCA, CCATCCTCGTTCTTCAYGGGCAC | Long QT syndrome 2, Congenital long QT syndrome |
| 77331749 | KCNH2 | NM_000238.3(KCNH2): c.2738C>T (p.Ala913Val) | CCTTGGGGCCGGGCCGGGYGGGG | Long QT syndrome 2, Congenital long QT syndrome, Long QT syndrome 2/9, digenic, Cardiac arrhythmia |
| 104894253 | KCNJ1 | NM_153767.3(KCNJ1): c.535G>A (p.Ala179Thr) | AACRCAGTGATCAGCAAACGGGG, GAACRCAGTGATCAGCAAACGGG, AGAACRCAGTGATCAGCAAACGG | Bartter syndrome antenatal type 2 |
| 137853067 | KCNJ10 | NM_002241.4(KCNJ10): c.595C>T (p.Arg199Ter) | CCCTGCCTCATGATCYGAGTTGC, CCTGCCTCATGATCYGAGTTGCC | SeSAME syndrome |
| 137853071 | KCNJ10 | NM_002241.4(KCNJ10): c.889C>T (p.Arg297Cys) | CCACCTGTCAGGTGYGCACTTCC | SeSAME syndrome |
| 137853074 | KCNJ10 | NM_002241.4(KCNJ10): c.1042C>T (p.Arg348Cys) | CCTCCGTGACAGCACTGTAYGCT, CCGTGACAGCACTGTAYGCTACG | Enlarged vestibular aqueduct syndrome |
| 80356615 | KCNJ11 | NM_000525.3(KCNJ11): c.158G>A (p.Gly53Asp) | GGAGCAGGRCCGCTTCCTGCAGG | Permanent neonatal diabetes mellitus, Diabetes mellitus, permanent neonatal, with neurologic features |
| 80356616 | KCNJ11 | NM_000525.3(KCNJ11): c.175G>A (p.Val59Met) | GGACRTGTTCACCACGCTGGTGG, GCAGGACRTGTTCACCACGCTGG | Permanent neonatal diabetes mellitus, Diabetes mellitus, permanent neonatal, with neurologic features, Neonatal insulin-dependent diabetes mellitus |
| 267607196 | KCNJ11 | NM_000525.3(KCNJ11): c.844G>A (p.Glu282Lys) | CCTCRAGATCATCGTCATCCTGG | Islet cell hyperplasia |
| 80356625 | KCNJ11 | NM_000525.3(KCNJ11): c.601C>T (p.Arg201Cys) | CCGCCTCTGCTTCATGCTAYGTG, CCTCTGCTTCATGCTAYGTGTGG | Permanent neonatal diabetes mellitus, Diabetes mellitus, permanent neonatal, with neurologic features, Diabetes mellitus |
| 527236152 | KCNJ18 | NM_001194958.2(KCNJ18): c.419C>T (p.Thr140Met) | CCTCTTCTCCATCGAGAYGCAGA | Thyrotoxic periodic paralysis |
| 527236157 | KCNJ18 | NM_001194958.2(KCNJ18): c.1219C>T (p.Gln407Ter) | CCGGGATGGCCTCAGCCCCYAGG | Thyrotoxic periodic paralysis |
| 527236158 | KCNJ18 | NM_001194958.2(KCNJ18): c.1061C>T (p.Thr354Met) | CCTATGAGGTGCCCTCTAYGCCC | Thyrotoxic periodic paralysis, Thyrotoxic periodic paralysis 2 |
| 104894584 | KCNJ2 | NM_000891.2(KCNJ2): c.514G>A (p.Asp172Asn) | ATCATCRATGCTTTCATCATTGG | Short QT syndrome 3, short QT syndrome |
| 104894581 | KCNJ2 | NM_000891.2(KCNJ2): c.557C>T (p.Pro186Leu) | CCAAGATGGCAAAGCYAAAGAAG | Andersen Tawil syndrome, Congenital long QT syndrome |
| 786204795 | KCNJ6 | NM_002240.4(KCNJ6): c.460G>A (p.Gly154Ser) | CACCATTRGTTATGGCTACCGGG, CCACCATTRGTTATGGCTACCGG | Keppen-Lubinsky syndrome |
| 121908332 | KCNK9 | NM_001282534.1(KCNK9): c.706G>A (p.Gly236Arg) | CATCRGGGCCTTCCTCAACCTGG | Birk Barel mental retardation dysmorphism syndrome |
| 794728531 | KCNQ1 | NM_000218.2(KCNQ1): c.1685+1G>A | AGGAGRTGGGCACGGCCAAACGG | Cardiac arrhythmia |
| 794728539 | KCNQ1 | NM_000218.2(KCNQ1): c.1794G>A (p.Lys598=) | GACAARGTAGGCTCACGCGCCGG | Cardiac arrhythmia |
| 794728553 | KCNQ1 | NM_000218.2(KCNQ1): c.343G>A (p.Glu115Lys) | TCCTCRAGCGTCCCACCGGCTGG | Cardiac arrhythmia |
| 794728572 | KCNQ1 | NM_000218.2(KCNQ1): c.176G>A (p.Trp392Ter) | CTGRAAGATCTACATCCGGAAGG, CCACCTGRAAGATCTACATCCGG | Cardiac arrhythmia |
| 17215479 | KCNQ1 | NM_000218.2(KCNQ1): c.643G>A (p.Val215Met) | CTGCRTGGGCTCCAAGGGCAGG, TCCTCTGCRTGGGCTCCAAGGGG | Congenital long QT syndrome, Long QT syndrome, LQT1 subtype |
| 120074183 | KCNQ1 | NM_000218.2(KCNQ1): c.1034G>A (p.Gly345Glu) | CCCAGGRGATTCTTGGCTCGGGG, TCCCAGGRGATTCTTGGCTCGGG, TTCCCAGGRGATTCTTGGCTCGG | Long QT syndrome 1, Congenital long QT syndrome, Long QT syndrome, LQT1 subtype |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 120074187 | KCNQ1 | NM_000218.2(KCNQ1): c.898G>A (p.Ala300Thr) | TACRCAGATGCGCTGTGGTGGGG, CTACRCAGATGCGCTGTGGTGGG, GCTACRCAGATGCGCTGTGGTGG, GCAGCTACRCAGATGCGCTGTGG | Long QT syndrome 1, Cardiac arrhythmia, not provided |
| 120074188 | KCNQ1 | NM_000218.2(KCNQ1): c.1573G>A (p.Ala525Thr) | TGTGRCCAAGAAGAAATTCCAGG | Congenital long QT syndrome, Cardiac arrhythmia, Long QT syndrome, LQT1 subtype |
| 199472688 | KCNQ1 | NM_000218.2(KCNQ1): c.436G>A (p.Glu146Lys) | CATCRAGCAGTATGCCGCCCTGG | Congenital long QT syndrome, Long QT syndrome, LQT1 subtype |
| 199472692 | KCNQ1 | NM_000218.2(KCNQ1): c.484G>A (p.Val162Met) | ATCRTGCTGGTGGTGTTCTTCGG | Congenital long QT syndrome, Cardiac arrhythmia |
| 199472694 | KCNQ1 | NM_000218.2(KCNQ1): c.514G>A (p.Val172Met) | CGGAGTACRTGGTCCGCCTCTGG | Congenital long QT syndrome |
| 199472736 | KCNQ1 | NM_000218.2(KCNQ1): c.875G>A (p.Gly292Asp) | GAGTCAGRCCGCGTGGAGTTCGG | Congenital long QT syndrome, Cardiac arrhythmia |
| 199472811 | KCNQ1 | NM_000218.2(KCNQ1): c.1750G>A (p.Gly584Ser) | GATCGCRGCAGCAACACGATCGG | Sudden infant death syndrome |
| 199473464 | KCNQ1 | NM_000218.2(KCNQ1): c.868G>A (p.Glu290Lys) | GGTGAACRAGTCAGGCCGCGTGG | Congenital long QT syndrome, Long QT syndrome, LQT1 subtype |
| 199473482 | KCNQ1 | NM_000218.2(KCNQ1): c.1748G>A (p.Arg583His) | GATCRCGGCAGCAACACGATCGG | Congenital long QT syndrome, Cardiac arrhythmia |
| 762814879 | KCNQ1 | NM_000218.2(KCNQ1): c.477+1G>A | GGATGRTACGTAGCATCTGAGGG, TGGATGRTACGTAGCATCTGAGG | Cardiac arrhythmia |
| 151344631 | KCNQ1 | NM_000218.2(KCNQ1): c.613G>A (p.Val205Met) | CATCRTGGTCGTGGCCTCCATGG | Long QT syndrome 1, Long QT syndrome, Congenital long QT syndrome, Cardiac arrhythmia, Long QT syndrome, LQT1 subtype, not provided |
| 149089817 | KCNQ1 | NM_000218.2(KCNQ1): c.1336G>A (p.Asp446Asn) | CGTGCRACCCCCAGAAGAGCGG | Cardiac arrhythmia |
| 397508070 | KCNQ1 | NM_000218.2(KCNQ1): c.1032+1G>A | CCCAGCGRTAGGTGCCCCGTGGG, TCCCAGCGRTAGGTGCCCCGTGG | Long QT syndrome, Cardiac arrhythmia, Long QT syndrome, LQT1 subtype |
| 140452381 | KCNQ1 | NM_000218.2(KCNQ1): c.1354C>T (p.Arg452Trp) | CCCCCCAGAAGAGCGGYGGCTGG, CCCCCAGAAGAGCGGYGGCTGGA, CCCCAGAAGAGCGGYGGCTGGAC | Long QT syndrome, Congenital long QT syndrome, Cardiac arrhythmia, Long QT syndrome, LQT1 subtype |
| 199472787 | KCNQ1 | NM_000218.2(KCNQ1): c.1555C>T (p.Arg519Cys) | CCATTAAGGTCATTCGAYGCATG | Congenital long QT syndrome |
| 199473446 | KCNQ1 | NM_000218.2(KCNQ1): c.197C>T (p.Ser66Phe) | CCCGCGCCCCTGCGTYCCCGGC, CCGCGCCCCTGCGTYCCCGCC | Congenital long QT syndrome |
| 199473450 | KCNQ1 | NM_000218.2(KCNQ1): c.409C>T (p.Leu137Phe) | CCTCATCGTCCTGGTCTGCYTCA | Congenital long QT syndrome, Cardiac arrhythmia, Long QT syndrome, LQT1 subtype |
| 775479779 | KCNQ1 | NM_000218.2(KCNQ1): c.642C>A (p.Cys214Ter) | CCTCCATGGTGGTCCTCTGHGTG, CCATGGTGGTCCTCTGHGTGGGC | Cardiac arrhythmia |
| 397508075 | KCNQ1 | NM_000218.2(KCNQ1): c.1075C>T (p.Gln359Ter) | CCTGAAGGTGCAGCAGAAGYAGA | Cardiac arrhythmia, Long QT syndrome, LQT1 subtype |
| 397508097 | KCNQ1 | NM_000218.2(KCNQ1): c.1588C>T (p.Gln530Ter) | CCAAGAAGAAATTCYAGGTAAGC | Long QT syndrome, Cardiac arrhythmia |
| 796052642 | KCNQ2 | NM_172107.2(KCNQ2): c.1009G>A (p.Ala337Thr) | CCCGGCARCAGGCCTGATCCAGG | not provided |
| 397514581 | KCNQ2 | NM_172107.2(KCNQ2): c.638G>A (p.Arg213Gln) | TGGACCRGCGGGGAGGCACCTGG | Early infantile epileptic encephalopathy 7, not provided |
| 397514582 | KCNQ2 | NM_172107.2(KCNQ2): c.869G>A (p.Gly290Asp) | CTGGAACGRCAGGCTCCTTGCGG | Early infantile epileptic encephalopathy 7 |
| 587777219 | KCNQ2 | NM_172107.2(KCNQ2): c.794C>T (p.Ala265Val) | CATCCRCGTAGGTGTCAAAGTGG | Early infantile epileptic encephalopathy 7, not provided |
| 796052634 | KCNQ2 | NM_172107.2(KCNQ2): c.809G>A (p.Trp270Ter) | TGGTRGGGCCTGGTGAGTTGTGG | not provided |
| 118192190 | KCNQ2 | NM_172107.2(KCNQ2): c.296+1G>A | CTACGTRTGAGTGGCCGGCGGGG, CCTACGTRTGAGTGGCCGGCGGG, GCCTACGTRTGAGTGGCCGGCGG | Benign familial neonatal seizures 1 |
| 118192200 | KCNQ2 | NM_172107.2(KCNQ2): c.620G>A (p.Arg207Gln) | TGCRGATGATCCGCATGGACCGG, GATTCTGCRGATGATCCGCATGG | Benign familial neonatal seizures 1, Seizures, benign familial neonatal, 1, and/or myokymia, not provided |
| 118192216 | KCNQ2 | NM_172107.2(KCNQ2): c.998G>A (p.Arg333Gln) | AAGAGGCRGAACCCGGCAGCAGG | Benign familial neonatal seizures 1 |
| 794727740 | KCNQ2 | NM_172107.2(KCNQ2): c.793G>A (p.Ala265Thr) | TACRCGGATGCACTCTGGTGGGG, CTACRCGGATGCACTCTGGTGGG, CCTACRCGGATGCACTCTGGTGG, ACACCTACRCGGATGCACTCTGG | Benign familial neonatal seizures 1, Seizures, Early infantile epileptic encephalopathy 7, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118192214 | KCNQ2 | NM_172107.2(KCNQ2): c.967C>T (p.Gln323Ter) | CCCTGAAGGTTCAGGAGYAGCAC, CCTGAAGGTTCAGGAGYAGCACA | Benign familial neonatal seizures 1 |
| 118192224 | KCNQ2 | NM_172107.2(KCNQ2): c.1288C>T (p.Pro430Ser) | CCCCTGTGTGGATGCTGCYCCGG, CCCTGTGTGGATGCTGCYCCGGA, CCTGTGTGGATGCTGCYCCGGAC | Benign familial neonatal seizures 1 |
| 118192236 | KCNQ2 | NM_172107.2(KCNQ2): c.1741C>T (p.Arg581Ter) | CCACCTGGACATGCTGTCCYGAA, CCTGGACATGCTGTCCYGAATTA | Benign familial neonatal seizures 1, not provided |
| 118192251 | KCNQ3 | NM_004519.3(KCNQ3): c.988C>T (p.Arg330Cys) | CCCAAAACGTGGGAAGGCYGTCT, CCAAAACGTGGGAAGGCYGTCTG | Benign familial neonatal seizures 2 |
| 28939710 | KCNQ4 | NM_004700.3(KCNQ4): c.961G>A (p.Gly321Ser) | AGGCTCCRGCTTTGCCCTGAAGG | DFNA 2 Nonsyndromic Hearing Loss |
| 80358279 | KCNQ4 | NM_004700.3(KCNQ4): c.886G>A (p.Gly296Ser) | CTGRGCAGGGTCCTGGCTGCTGG | DFNA 2 Nonsyndromic Hearing Loss |
| 397515402 | KCNT1 | NM_020822.2(KCNT1): c.1283G>A (p.Arg428Gln) | CAGCRGGTCATCTACCTCCAGGG, CCAGCRGGTCATCTACCTCCAGG | Early infantile epileptic encephalopathy 14, Epilepsy, nocturnal frontal lobe, 5 |
| 397515404 | KCNT1 | NM_020822.2(KCNT1): c.1421G>A (p.Arg474His) | CCTGCRCGCCTGGGCCGTGAAGG | Early infantile epileptic encephalopathy 14 |
| 587777264 | KCNT1 | NM_020822.2(KCNT1): c.862G>A (p.Gly288Ser) | GACCTGCRGCATCCAGCACCTGG | Early infantile epileptic encephalopathy 14 |
| 397515405 | KCNT1 | NM_020822.2(KCNT1): c.2782C>T (p.Arg928Cys) | CCCACCCTTCCAACATGYGCTTC, CCACCCTTCCAACATGYGCTTCA | Epilepsy, nocturnal frontal lobe, 5 |
| 387907302 | KCNV2 | NM_133497.3(KCNV2): c.226C>T (p.Gln76Ter) | CCTGGCAGAAGAGGACYAGCAGG | Retinal cone dystrophy 3B |
| 786205860 | KCTD17 | NM_001282684.1(KCTD17): c.434G>A (p.Arg145His) | GTACCRCGTGCTGCAGTGCCAGG | DYSTONIA 26, MYOCLONIC |
| 387907260 | KCTD7 | NM_153033.4(KCTD7): c.280C>T (p.Arg94Trp) | CCCCACGGACTCCGAGGGCYGGT, CCCACGGACTCCGAGGGCYGGTA, CCACGGACTCCGAGGGCYGGTAC | Epilepsy, progressive myoclonic 3 |
| 199422234 | KDM5C | NM_004187.3(KDM5C): c.2191C>T (p.Leu731Phe) | CCCAGACGGCCTTGTCTGCYTTT, CCAGACGGCCTTGTCTGCYTTTC | Mental retardation, syndromic, Claes-Jensen type, X-linked |
| 121917860 | KERA | NM_007035.3(KERA): c.520C>T (p.Gln174Ter) | CCTGACCCTTCTTGACCTAYAGA, CCCTTCTTGACCTAYAGAACAAC | Cornea plana 2 |
| 730882122 | KIF11 | NM_004523.3(KIF11): c.790-1G>A | AAATTAAARGTTGATCTTGCAGG | Microcephaly with or without chorioretinopathy, lymphedema, or mental retardation |
| 672601369 | KIF1A | NM_001244008.1(KIF1A): c.757G>A (p.Glu253Lys) | AGCRAGCGGGCTGACTCCACGGG, GAGCRAGCGGGCTGACTCCACGG | Mental retardation, autosomal dominant 9 |
| 267607200 | KIF21A | NM_001173464.1(KIF21A): c.2841G>A (p.Met947Ile) | AGATATRAATAGACTCCTCAAGG | Fibrosis of extraocular muscles, congenital, 3b |
| 121912585 | KIF21A | NM_001173464.1(KIF21A): c.2860C>T (p.Arg954Trp) | CCTGCTTTCTCAATAGCAAYGGG | Fibrosis of extraocular muscles, congenital, 1, Fibrosis of extraocular muscles, congenital, 3b |
| 387907288 | KIF5A | NM_004984.2(KIF5A): c.839G>A (p.Arg280His) | ATCRTGACAGCAAAATGACAAGG | Spastic paraplegia 10 |
| 387907289 | KIF5A | NM_004984.2(KIF5A): c.704G>A (p.Gly235Glu) | GCAGRGAGTGAGAAGGTAGGGGG, GGCAGRGAGTGAGAAGGTAGGGG, TGGCAGRGAGTGAGAAGGTAGGG, CTGGCAGRGAGTGAGAAGGTAGG | Spastic paraplegia 10 |
| 121434444 | KIF5A | NM_004984.2(KIF5A): c.1082C>T (p.Ala361Val) | CCCAGAAGGAGACGATTGYGAAG, CCAGAAGGAGACGATTGYGAAGC | Spastic paraplegia 10 |
| 794727316 | KIF7 | NM_198525.2(KIF7): c.61C>T (p.Arg21Ter) | CCCAGTGCGGGTTGCCCTGYGAG, CCAGTGCGGGTTGCCCTGYGAGT | Acrocallosal syndrome, Schinzel type |
| 104894701 | KISS1R | NM_032551.4(KISS1R): c.991C>T (p.Arg331Ter) | CCTGGGCTCGCACTTCYGACAGG | |
| 794726675 | KIT | NM_000222.2(KIT): c.1879+1G>A | CTCAAGCRTAAGTTCCTGTATGG | Partial albinism |
| 121913680 | KIT | NM_000222.2(KIT): c.1747G>A (p.Glu583Lys) | AATGGRAGTTTCCCAGAAACAGG | Partial albinism |
| 370756367 | KLHL10 | NM_152467.3(KLHL10): c.937G>A (p.Ala313Thr) | TGACRCTCGGGCAGACAGATGGG, ATGACRCTCGGGCAGACAGATGG | Spermatogenic failure 11 |
| 199469643 | KLHL3 | NM_017415.2(KLHL3): c.1292G>A (p.Arg431Gln) | CGGCRGAGCAGTGTGGGTGTGGG, GCGGCRGAGCAGTGTGGGTGTGG | Pseudohypoaldosteronism, type 2 |
| 199469628 | KLHL3 | NM_017415.2(KLHL3): c.1019C>T (p.Ala340Val) | CCTTCCAGAAGATGCAGAGYAGA, CCAGAAGATGCAGAGYAGGTGAG | Pseudohypoaldosteronism, type 2 |
| 730882260 | KLHL41 | NM_006063.2(KLHL41): c.1238C>T (p.Ser413Leu) | CCTTCAAACAGAGGCTTYGCTGG | Nemaline myopathy 9 |
| 104894704 | KLK4 | NM_004917.4(KLK4): c.458G>A (p.Trp153Ter) | GGCTRGGGTCTGCTGGCAGAACGG | Amelogenesis imperfecta, hypomaturation type, IIA1 |
| 794727420 | KMT2D | NM_003482.3(KMT2D): c.5677C>T (p.Gln1893Ter) | CCAAGGACCTGCAGYAGCTCTTC | Kabuki make-up syndrome |
| 794727549 | KMT2D | NM_003482.3(KMT2D): c.7903C>T (p.Arg2635Ter) | CCCATGGAGCCTCACAGYGATCA, CCATGGAGCCTCACAGYGATCAG | Kabuki make-up syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783685 | KMT2D | NM_003482.3(KMT2D): c.12592C>T (p.Arg4198Ter) | CCTACGGTGGGTCAGCTTYGAGC | Kabuki make-up syndrome |
| 587783699 | KMT2D | NM_003482.3(KMT2D): c.15943C>T (p.Gln5315Ter) | CCCGGGGTGGAGAGCTGTYAAAA, CCGGGGTGGAGAGCTGTYAAAAC | Kabuki make-up syndrome |
| 587783711 | KMT2D | NM_003482.3(KMT2D): c.3121C>T (p.Gln1041Ter) | CCAAAACTCCCCTCCTTCCYAGT | Kabuki make-up syndrome |
| 398123704 | KMT2D | NM_003482.3(KMT2D): c.11149C>T (p.Gln3717Ter) | CCTGATTCAAGGCTTTTAYAGGA | Kabuki make-up syndrome, not provided |
| 398123708 | KMT2D | NM_003482.3(KMT2D): c.11692C>T (p.Gln3898Ter) | CCCATGGGCTCTTTAYAGCAGCT, CCATGGGCTCTTTAYAGCAGCTT | Kabuki make-up syndrome, not provided |
| 398123711 | KMT2D | NM_003482.3(KMT2D): c.12406C>T (p.Gln4136Ter) | CCCCACCTGCTGGCTYAGCCCTC, CCCACCTGCTGGCTYAGCCCTCT | Kabuki make-up syndrome, not provided |
| 398123721 | KMT2D | NM_003482.3(KMT2D): c.14710C>T (p.Arg4904Ter) | CCAATCTGGATGTGYGACAGCTC | Kabuki make-up syndrome, not provided |
| 398123757 | KMT2D | NM_003482.3(KMT2D): c.7066C>T (p.Gln2356Ter) | CCAGGAGCCACCCCCTGCCYAGG | Kabuki make-up syndrome, not provided |
| 59977263 | KRT17 | NM_000422.2(KRT17): c.304G>A (p.Val102Met) | CAAGRTGCGTGCCCTGGAGGAGG, GGACAAGRTGCGTGCCCTGGAGG | Pachyonychia congenita type 2, not provided |
| 137852629 | KRT2 | NM_000423.2(KRT2): c.1459G>A (p.Glu487Lys) | AGGGCRAGGAGTGCAGGTGAGGG, GAGGGCRAGGAGTGCAGGTGAGG | Ichthyosis bullosa of Siemens, Ichthyosis exfoliativa, not provided |
| 121912476 | KRT5 | NM_000424.3(KRT5): c.1252G>A (p.Glu418Lys) | TGCCRAGCAGCGTGGGGAGCTGG | Epidermolysis bullosa simplex, autosomal recessive, not provided |
| 57499817 | KRT5 | NM_000424.3(KRT5): c.74C>T (p.Pro25Leu) | CCGCCTCTGCCATCACCCYGTCT, CCTCTGCCATCACCCYGTCTGTC | Epidermolysis bullosa simplex with mottled pigmentation, not provided |
| 60554162 | KRT6A | NM_005554.3(KRT6A): c.1414G>A (p.Glu472Lys) | GGAGGGTRAGGAGTGCAGGTGGG, TGGAGGGTRAGGAGTGCAGGTGG | PC-K6a, not provided |
| 60627726 | KRT6B | NM_005555.3(KRT6B): c.1414G>A (p.Glu472Lys) | GGAGGGCRAGGAGTGCAGGTGGG, TGGAGGGCRAGGAGTGCAGGTGG | Pachyonychia congenita 4, not provided |
| 587777292 | KRT6C | NM_173086.4(KRT6C): c.1414G>A (p.Glu472Lys) | CCTACCTGCACTCCTYGCCCTCC | Palmoplantar keratoderma, nonepidermolytic, focal or diffuse |
| 57802288 | KRT83 | NM_002282.3(KRT83): c.1219G>A (p.Glu407Lys) | ATATCRAGATCGCCACCTACAGG | Beaded hair, not provided |
| 57019720 | KRT9 | NM_000226.3(KRT9): c.511G>A (p.Val171Met) | TAAGRTGCAGGCTCTAGAGGAGG, GGATAAGRTGCAGGCTCTAGAGG | Epidermolytic palmoplantar keratoderma, not provided |
| 137852519 | L1CAM | NM_000425.4(L1CAM): c.1792G>A (p.Asp598Asn) | ACTGRATGTGGTGGAGAGTAGGG, AACTGRATGTGGTGGAGAGTAGG | Spastic paraplegia 1 |
| 137852524 | L1CAM | NM_000425.4(L1CAM): c.1108G>A (p.Gly370Arg) | ATCAACRGGATCCCTGTGGAGGG, AATCAACRGGATCCCTGTGGAGG | Spastic paraplegia 1 |
| 137852525 | L1CAM | NM_000425.4(L1CAM): c.2254G>A (p.Val752Met) | CGCRTGCAGTGGCGCCCTCAGGG, CCGCRTGCAGTGGCGCCCTCAGG | |
| 118204021 | L2HGDH | NM_024884.2(L2HGDH): c.164G>A (p.Gly55Asp) | TCGTTGRTGGCGGAATTGTGGGG, ATCGTTGRTGGCGGAATTGTGGG, CATCGTTGRTGGCGGAATTGTGG | L-2-hydroxyglutaric aciduria |
| 121913574 | LAMA2 | NM_000426.3(LAMA2): c.1580G>A (p.Cys527Tyr) | ACAGATRTCAGAGTTCCTACTGG | Congenital muscular dystrophy due to partial LAMA2 deficiency, not provided |
| 398123367 | LAMA2 | NM_000426.3(LAMA2): c.112+1G>A | AAGAGRTACAGTCGAGGCATGGG, AAAGAGRTACAGTCGAGGCATGG | Merosin deficient congenital muscular dystrophy, not provided |
| 9492297 | LAMA2 | NM_000426.3(LAMA2): c.2750-1G>C | GCARCCTGTCGCTGTAATGCCGG | Merosin deficient congenital muscular dystrophy, not provided |
| 398123391 | LAMA2 | NM_000426.3(LAMA2): c.9212-1G>A | TCARATGACCTCAAGCAGTTTGG | Merosin deficient congenital muscular dystrophy, not provided |
| 121913571 | LAMA2 | NM_000426.3(LAMA2): c.9253C>T (p.Arg3085Ter) | CCAGTATTCCGTTCYGAGGTTGC | Merosin deficient congenital muscular dystrophy |
| 121913572 | LAMA2 | NM_000426.3(LAMA2): c.7732C>T (p.Arg2578Ter) | CCACCTAGGAGAAAAYGAAGGCA | Merosin deficient congenital muscular dystrophy, not provided |
| 727502851 | LAMA2 | NM_000426.3(LAMA2): c.7888C>T (p.Arg2630Ter) | CCGTTCATGTAGAGYGAACTAGA | Congenital muscular dystrophy |
| 398123373 | LAMA2 | NM_000426.3(LAMA2): c.3976C>T (p.Arg1326Ter) | CCATAGAACTGTGACCYGAGAAG | Merosin deficient congenital muscular dystrophy, not provided |
| 398123378 | LAMA2 | NM_000426.3(LAMA2): c.5914C>T (p.Gln1972Ter) | CCAAAGGCTGTCTTYAGAAAAGC | Merosin deficient congenital muscular dystrophy, not provided |
| 137852757 | LAMA3 | NM_198129.2(LAMA3): c.6808C>T (p.Arg2270Ter) | CCAATCTCACAACTCTCYGAGAT | Junctional epidermolysis bullosa gravis of Herlitz |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852758 | LAMA3 | NM_198129.2(LAMA3): c.8962C>T (p.Gln2988Ter) | CCAATCATGGAGCCCTCYAGTTT | Adult junctional epidermolysis bullosa |
| 730880125 | LAMB2 | NM_002292.3(LAMB2): c.2890C>T (p.Arg964Ter) | CCGTGGGCAGGGCTGYGATGTGA | Pierson syndrome |
| 267607208 | LAMB2 | NM_002292.3(LAMB2): c.4177C>T (p.Leu1393Phe) | CCAGCGGGCACTTGGCAAGYTCT | Nephrotic syndrome, type 5, with or without ocular abnormalities |
| 121912484 | LAMB3 | NM_000228.2(LAMB3): c.1830G>A (p.Trp610Ter) | GTGRTCAGGGCCTGGGCTGGAGG, CCTGTGRTCAGGGCCTGGGCTGG | Junctional epidermolysis bullosa gravis of Herlitz |
| 80356681 | LAMB3 | NM_000228.2(LAMB3): c.727C>T (p.Gln243Ter) | CCTACTATGCTGTGTCCYAGCTC | Junctional epidermolysis bullosa gravis of Herlitz |
| 121912483 | LAMB3 | NM_000228.2(LAMB3): c.496C>T (p.Gln166Ter) | CCGCCAGGGTCGGCCTYAGAGCT | Junctional epidermolysis bullosa gravis of Herlitz |
| 587776812 | LAMB3 | NM_000228.2(LAMB3): c.628+42G>A | CCAACTCTGTTTCCTTTYCCACC | Adult junctional epidermolysis bullosa |
| 387906887 | LAMC3 | NM_006059.3(LAMC3): c.1156C>T (p.Gln386Ter) | CCAGCCCTGTGACTGCYAGTCGA | Cortical malformations, occipital |
| 104894858 | LAMP2 | NM_002294.2(LAMP2): c.928G>A (p.Val310Ile) | GGCTCCRGTAAGCAAAGCACTGG | Cardiomyopathy, Danon disease |
| 398124181 | LARGE | NM_004737.4(LARGE): c.1102C>T (p.Gln368Ter) | CCACACCCGCTCCGAGYAGTGCT | not provided |
| 398123036 | LARS2 | NM_015340.3(LARS2): c.1886C>T (p.Thr629Met) | CCTGTTCATGCAAAAAYGAAAGA | Perrault syndrome 4 |
| 121908050 | LCAT | NM_000229.1(LCAT): c.440C>T (p.Thr147Ile) | CCCACAGGGTACCTGCACAYACT, CCACAGGGTACCTGCACAYACTG | Fish-eye disease |
| 387906300 | LCAT | NM_000229.1(LCAT): c.544C>T (p.Arg182Cys) | CCAGCAGGAGGAGTACTACYGCA | Norum disease |
| 45514002 | LDB3 | NM_007078.2(LDB3): c.2017G>A (p.Asp673Asn) | TGCRATTTCCCCGTGGAGGCTGG, TGGCTGCRATTTCCCCGTGGAGG | Dilated cardiomyopathy 1C, Left ventricular noncompaction 3 |
| 45487699 | LDB3 | NM_007078.2(LDB3): c.566C>T (p.Ser189Leu) | CCAAAAGCCCTGCCGGGCTYGAG | Dilated cardiomyopathy 1C, not specified, not provided, Familial hypertrophic cardiomyopathy 24 |
| 121908335 | LDB3 | NM_001080116.1(LDB3): c.802C>T (p.Arg268Cys) | CCCACGTTTTGCCAAATTGYGCA, CCACGTTTTGCCAAATTGYGCAA | Myofibrillar myopathy, ZASP-related, not specified |
| 121908337 | LDB3 | NM_007078.2(LDB3): c.617C>T (p.Thr206Ile) | CCTGTACTCGGCAGAGAYCCTGA | Dilated cardiomyopathy 1C |
| 375009082 | LDLR | NM_000527.4(LDLR): c.2098G>A (p.Asp700Asn) | CTGCCCGRACGGCATGCTGCTGG | not provided |
| 121908033 | LDLR | NM_000527.4(LDLR): c.523G>A (p.Asp175Asn) | GCGAARATGGCTCGGATGAGTGG | Familial hypercholesterolemia |
| 121908037 | LDLR | NM_000527.4(LDLR): c.2531G>A (p.Gly844Asp) | GGACGRCTACAGCTACCCCTCGG | Familial hypercholesterolemia |
| 768563000 | LDLR | NM_000527.4(LDLR): c.718G>A (p.Glu240Lys) | GACRAATTCCAGTGCTCTGATGG | not provided |
| 28942081 | LDLR | NM_000527.4(LDLR): c.1637G>A (p.Gly546Asp) | GAAAGGGGRCCTGAATGGTGTGG | Familial hypercholesterolemia |
| 139361635 | LDLR | NM_000527.4(LDLR): c.1024G>A (p.Asp342Asn) | CCCCRACGGCTTCCAGCTGGTGG, GTGCCCCRACGGCTTCCAGCTGG | Hypercholesterolaemia, not provided |
| 387906303 | LDLR | NM_000527.4(LDLR): c.670G>A (p.Asp224Asn) | CTGCAAGRACAAATCTGACGAGG | Familial hypercholesterolemia |
| 121908026 | LDLR | NM_000527.4(LDLR): c.530C>T (p.Ser177Leu) | CCCGACTGCGAAGATGGCTYGGA, CCGACTGCGAAGATGGCTYGGAT | Familial hypercholesterolemia, not provided |
| 121908044 | LDLR | NM_000527.4(LDLR): c.621C>T (p.Gly207=) | CCACTGCCTAAGTGGYGAGTGCA | Familial hypercholesterolemia |
| 752596535 | LDLR | NM_000527.4(LDLR): c.501C>A (p.Cys167Ter) | CCCCCAGCTGTGGGCCTGHGACA, CCCCAGCTGTGGGCCTGHGACAA, CCCAGCTGTGGGCCTGHGACAAC, CCAGCTGTGGGCCTGHGACAACG | not provided |
| 121908324 | LDLRAP1 | NM_015627.2(LDLRAP1): c.65G>A (p.Trp22Ter) | AGAGCTRGGGGGCGGTGGCCGG | Hypercholesterolemia, autosomal recessive |
| 121909126 | LEFTY2 | NM_003240.3(LEFTY2): c.1025G>A (p.Ser342Asn) | GGTCARCCTGCCCAACATGAGGG, TGGTCARCCTGCCCAACATGAGG | Left-right axis malformations |
| 121909125 | LEFTY2 | NM_003240.3(LEFTY2): c.940C>T (p.Arg314Ter) | CCATTTCTGGGGCCGYGACAGTG | Left-right axis malformations |
| 121912517 | LHB | NM_000894.2(LHB): c.167G>A (p.Gly56Asp) | TGCCGRCTACTGCCCCACCATGG | Isolated lutropin deficiency |
| 137854503 | LHX3 | NM_178138.4(LHX3): c.629C>T (p.Ala210Val) | CCAGAACCGCCGGGYCAAGGAGA | Pituitary hormone deficiency, combined 3 |
| 121912642 | LHX4 | NM_033343.3(LHX4): c.250C>T (p.Arg84Cys) | CCTGCTGCCCTGACAGGYGCTTC | Pituitary hormone deficiency, combined 4 |
| 121434560 | LIG1 | NM_000234.2(LIG1): c.1696G>A (p.Glu566Lys) | CCTGCRAATACAAATATGACGGG, ACCTGCRAATACAAATATGACGG | |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434561 | LIG1 | NM_000234.2(LIG1): c.2311C>T (p.Arg771Trp) | CCTGGGCCGGGGAAGYGGGCCG | |
| 104894420 | LIG4 | NM_002312.3(LIG4): c.1406G>A (p.Gly469Glu) | GTTGGAGRATATTGGGGTAAAGG | Lig4 syndrome |
| 104894419 | LIG4 | NM_002312.3(LIG4): c.2440C>T (p.Arg814Ter) | CCTCTCAGTATGTTTYGACGCCA | Lig4 syndrome |
| 116928232 | LIPA | NM_000235.3(LIPA): c.894G>A (p.Gln298=) | CCTGGAATGCCTACYTGGCTCCA | Lysosomal acid lipase deficiency |
| 104894519 | LITAF | NM_004862.3(LITAF): c.334G>A (p.Gly112Ser) | ATAACGCCRGTGCTCTGACCTGG | CHARCOT-MARIE-TOOTH DISEASE, DEMYELINATING, TYPE 1C |
| 587777626 | LMF1 | NM_022773.2(LMF1): c.1391G>A (p.Trp464Ter) | CCGCGAACCACATCAGCYAGTCC | Lipase deficiency combined |
| 794728589 | LMNA | NM_170707.3(LMNA): c.356+1G>A | GCGCGRTGAGTTCGCCCAGGTGG, AAAGCGCGRTGAGTTCGCCCAGG | not provided |
| 368386019 | LMNA | NM_170707.3(LMNA): c.1931G>A (p.Arg644His) | GTCACCCRCTCCTACCTCCTGGG, GGTCACCCRCTCCTACCTCCTGG | Congenital muscular dystrophy, not provided |
| 121912493 | LMNA | NM_170707.3(LMNA): c.1318G>A (p.Val440Met) | GCGCRTGGCCGTGGAGGAGGTGG, CGGGCGCRTGGCCGTGGAGGAG | Mandibuloacral dysplasia with type A lipodystrophy, atypical, not provided |
| 121912494 | LMNA | NM_170707.3(LMNA): c.1585G>A (p.Ala529Thr) | ACGRCTCTCATCAACTCCACTGG | Mandibuloacral dysostosis, not provided |
| 61064130 | LMNA | NM_170707.3(LMNA): c.1822G>A (p.Gly608Ser) | GTGRGCGGACCCATCTCCTCTGG | Hutchinson-Gilford syndrome, not provided |
| 267607548 | LMNA | NM_170707.3(LMNA): c.1039G>A (p.Glu347Lys) | AGATGGCCRAGATGCGGGCAAGG | not provided |
| 267607552 | LMNA | NM_170707.3(LMNA): c.1380+1G>A | ATGAGRTAGGCTCCTGCTCAGGG, AATGAGRTAGGCTCCTGCTCAGG | not provided |
| 267607571 | LMNA | NM_170707.3(LMNA): c.569G>A (p.Arg190Gln) | GGCRGGTGGATGCTGAGAACAGG | not provided |
| 267607590 | LMNA | NM_170707.3(LMNA): c.1157+1G>A | GAGRTGGGCTGGGGAGACGTCGG | not provided |
| 267607592 | LMNA | NM_170707.3(LMNA): c.1608+1G>A | GAARTAAGTAGGCCTGGGCCTGG, CTGGGGAARTAAGTAGGCCTGGG | Limb-girdle muscular dystrophy, type 1B, not provided |
| 267607640 | LMNA | NM_170707.3(LMNA): c.1488+1G>A | ACGRTGAGTGGCAGGGCGCTTGG | Mandibuloacral dysostosis, not provided |
| 59270054 | LMNA | NM_170707.3(LMNA): c.244G>A (p.Glu82Lys) | CGCCTACRAGGCCGAGCTCGGGG, CCGCCTACRAGGCCGAGCTCGGG | Dilated cardiomyopathy 1A, not provided |
| 201583907 | LMNA | NM_170707.3(LMNA): c.1567G>A (p.Gly523Arg) | CTGCVGGAACAGCCTGCGTACGG | not specified, not provided |
| 28933093 | LMNA | NM_170707.3(LMNA): c.481G>A (p.Glu161Lys) | GGCRAGCTGCATGATCTGCGGGG, GGGCRAGCTGCATGATCTGCGGG, AGGGCRAGCTGCATGATCTGCGG | Dilated cardiomyopathy 1A, not provided |
| 57508089 | LMNA | NM_170707.3(LMNA): c.1146C>T (p.Gly382=) | CCGCAAGCTCTTGGAGGGYGAGG | Dilated cardiomyopathy 1A, not provided |
| 794728591 | LMNA | NM_170707.3(LMNA): c.646C>T (p.Arg216Cys) | CCAACCCTTCCAGGAGCTGYGTG, CCCTTCCAGGAGCTGYGTGAGAC, CCTTCCAGGAGCTGYGTGAGACC | not provided |
| 60890628 | LMNA | NM_170707.3(LMNA): c.1718C>T (p.Ser573Leu) | CCCACTGCAGCAGCTYGGGGAC, CCACTGCAGCAGCTYGGGGACC | Dilated cardiomyopathy 1A, Lipodystrophy, familial partial, type 2, Mandibuloacral dysplasia with type A lipodystrophy, atypical, not specified, not provided |
| 56699480 | LMNA | NM_170707.3(LMNA): c.1477C>T (p.Gln493Ter) | CCCTGAAGGCTGGGYAGGTGGTG | Limb-girdle muscular dystrophy, type 1B, not provided |
| 58672172 | LMNA | NM_170707.3(LMNA): c.1195C>T (p.Arg399Cys) | CCCTACCTCGCAGCGCAGCYGTG, CCTACCTCGCAGCGCAGCYGTGG, CCTCGCAGCGCAGCYGTGGCGT | Lipodystrophy, familial partial, type 2, not provided |
| 57920071 | LMNA | NM_005572.3(LMNA): c.1444C>T (p.Arg482Trp) | CCCTTGCTGACTTACYGGTTCCC, CCTTGCTGACTTACYGGTTCCCA | Lipodystrophy, familial partial, type 2, not provided |
| 267607554 | LMNA | NM_170707.3(LMNA): c.961C>T (p.Arg321Ter) | CCAAGGAGGCGAAGCTTYGAGAC | Dilated cardiomyopathy 1A, not provided |
| 267607587 | LMNA | NM_170707.3(LMNA): c.736C>T (p.Gln246Ter) | CCGGCTGGCGGATGCGCTGYAGG | not provided |
| 57077886 | LMNA | NM_170707.3(LMNA): c.29C>T (p.Thr10Ile) | CCGTCCCAGCGGCGCGCCAYCCG, CCCAGCGGCGCGCCAYCCGCAGC, CCAGCGGCGCGCCAYCCGCAGCG | Dilated cardiomyopathy 1A, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61046466 | LMNA | NM_170707.3(LMNA): c.16C>T (p.Gln6Ter) | CCATGGAGACCCCGTCCYAGCGG | Benign scapuloperoneal muscular dystrophy with cardiomyopathy, Dilated cardiomyopathy 1A, not provided |
| 121909487 | LMX1B | NM_002316.3(LMX1B): c.661C>T (p.Arg221Ter) | CCCGCGGAGGCCCAAGYGACCCC, CCGCGGAGGCCCAAGYGACCCCG | Nail-patella syndrome |
| 121909490 | LMX1B | NM_002316.3(LMX1B): c.691C>T (p.Arg231Ter) | CCTCACCACGCAGCAGYGAAGA G | Nail-patella syndrome |
| 121909492 | LMX1B | NM_002316.3(LMX1B): c.745C>T (p.Arg249Ter) | CCTCTCTCTGAGCCAGGTCYGAG | Nail-patella syndrome |
| 201587138 | LOXHD1 | NM_144612.6(LOXHD1): c.4480C>T (p.Arg1494Ter) | ATCRCTCCCCAGTGTCCCCGAGG | Deafness, autosomal recessive 77 |
| 119480072 | LPIN1 | NM_145693.2(LPIN1): c.1162C>T (p.Arg388Ter) | CCGTTTTAGATAAAYGAAGCCGA | Myoglobinuria, acute recurrent, autosomal recessive |
| 118204070 | LPL | NM_000237.2(LPL): c.272G>A (p.Trp91Ter) | GAGTTRGGTGCCAAAACTTGTGG | Hyperlipoproteinemia, type I |
| 118204075 | LPL | NM_000237.2(LPL): c.665G>A (p.Gly222Glu) | TTGRAATCCAGAAACCAGTTGGG, ATTGRAATCCAGAAACCAGTTGG | Hyperlipoproteinemia, type I |
| 118204058 | LPL | NM_000237.2(LPL): c.397C>T (p.Gln133Ter) | CCAAACTGGTGGGAYAGGATGTG | Hyperlipoproteinemia, type I |
| 376610215 | LRIT3 | NM_198506.4(LRIT3): c.983G>A (p.Cys328Tyr) | CAAATRTAAGGCCAAAAATCTGG | Congenital stationary night blindness, type 1F |
| 397509378 | LRIT3 | NM_198506.4(LRIT3): c.1318C>T (p.Arg440Ter) | CCACCATGGCCAACAAGYGATCA, CCATGGCCAACAAGYGATCATTC | Congenital stationary night blindness, type 1F |
| 587776717 | LRP2 | NM_004525.2(LRP2): c.2640-1G>A | CCAGTACAATCGTGAAGCAYTAA | Donnai Barrow syndrome |
| 80338744 | LRP2 | NM_004525.2(LRP2): c.1093C>T (p.Arg365Ter) | CCAGAAGTGTGAAAGCYGACCTG | Donnai Barrow syndrome |
| 267607220 | LRP4 | NM_002334.3(LRP4): c.1585G>A (p.Asp529Asn) | GGACCRACTCAGGCACCTCGAGG | Syndactyly Cenani Lenz type |
| 267607221 | LRP4 | NM_002334.3(LRP4): c.479G>A (p.Cys160Tyr) | GAAGCTRCATTGCTGAGCATTGG | Syndactyly Cenani Lenz type |
| 746136135 | LRP4 | NM_002334.3(LRP4): c.3830G>A (p.Arg1277His) | CCAGTACCCTTGTCAGCAYGGTG | MYASTHENIC SYNDROME, CONGENITAL, 17 |
| 80358312 | LRP5 | NM_002335.3(LRP5): c.1709G>A (p.Arg570Gln) | CGAGCRGGTGCACAAGGTCAAGG | |
| 121908670 | LRP5 | NM_002335.3(LRP5): c.724G>A (p.Ala242Thr) | CTTCRCCCTGACGCTCTCCGGGG, CCTTCRCCCTGACGCTCTCCGGG, CCCTTCRCCCTGACGCTCTCCGG | Worth disease, Van Buchem disease type 2, Osteopetrosis autosomal dominant type 1 |
| 397514663 | LRP5 | NM_002335.3(LRP5): c.1655C>T (p.Thr552Met) | CCGCACATTTTTGGGTTCAYGCT | Osteoporosis with pseudoglioma |
| 397514664 | LRP5 | NM_002335.3(LRP5): c.1145C>T (p.Pro382Leu) | CCATCGACTACGACCYGCTAGAG | Osteoporosis with pseudoglioma |
| 397514665 | LRP5 | NM_002335.3(LRP5): c.731C>T (p.Thr244Met) | CCCCTTCGCCCTGAYGCTCTCCG | Osteoporosis with pseudoglioma |
| 80358308 | LRP5 | NM_002335.3(LRP5): c.1330C>T (p.Arg444Cys) | CCGCATCGAGGTGACGYGCCTCA | |
| 121908663 | LRP5 | NM_002335.3(LRP5): c.2557C>T (p.Gln853Ter) | CCCGTTCGGTCTGACGYAGTACA, CCGTTCGGTCTGACGYAGTACAG | Osteoporosis with pseudoglioma |
| 397515474 | LRP6 | NM_002336.2(LRP6): c.1418G>A (p.Arg473Gln) | ATTGAGCRAGCAGCTCTGGATGG | Coronary artery disease, autosomal dominant 2 |
| 137853187 | LRTOMT | NM_001145308.4(LRTOMT): c.328G>A (p.Glu110Lys) | TGCRAGTACTTGAGCCACATGGG, CTGCRAGTACTTGAGCCACATGG | Deafness, autosomal recessive 63 |
| 387907175 | LTBP2 | NM_000428.2(LTBP2): c.4313G>A (p.Cys1438Tyr) | GCTRCACCCAGGGCGCTAGCTGG | Microspherophakia |
| 137854856 | LTBP2 | NM_000428.2(LTBP2): c.3529G>A (p.Val1177Met) | AGATRGAATGAGTGCATGGGGG, CAGATRTGAATGAGTGCATGGGG, GCAGATRTGAATGAGTGCATGGG, TGCAGATRTGAATGAGTGCATGG | Weill-Marchesani syndrome 1, Weill-Marchesani syndrome 3 |
| 121918356 | LTBP2 | NM_000428.2(LTBP2): c.331C>T (p.Gln111Ter) | CCGTCCCGCGCAGYAGTCGCG | Glaucoma 3, primary congenital, d |
| 137854855 | LTBP2 | NM_000428.2(LTBP2): c.1642C>T (p.Arg548Ter) | CCCAGCAGCACCCAGGCCTYGAG, CCAGCAGCACCCAGGCCTYGAGG | Marfan syndrome |
| 397515430 | LTBP4 | NM_001042544.1(LTBP4): c.1453C>T (p.Arg485Ter) | CCTGGGCCAGGAGCCACCCYGAG | Cutis laxa with severe pulmonary, gastrointestinal, and urinary abnormalities |
| 587777433 | LYRM7 | NM_181705.3(LYRM7): c.73G>A (p.Asp25Asn) | AATRATGCCAGAGCATTAGAAGG | MITOCHONDRIAL COMPLEX III DEFICIENCY, NUCLEAR TYPE 8 |
| 80338652 | LYST | NM_000081.3(LYST): c.3310C>T (p.Arg1104Ter) | CCTCACTTCAAAGTATAYGACTT | Ch\xc3\xa9diak-Higashi syndrome, Chediak-Higashi syndrome, adult type |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777180 | LZTR1 | NM_006767.3(LZTR1): c.1397G>A (p.Arg466Gln) | CGCRGAGCCGCTGGCTTCGCAGG | Schwannomatosis 2 |
| 587777177 | LZTR1 | NM_006767.3(LZTR1): c.365C>T (p.Ser122Leu) | CCCCCCGTTACCACCACTYGGCC, CCCCCGTTACCACCACTYGGCCG, CCCCGTTACCACCACTYGGCCGT, CCCGTTACCACCACTYGGCCGTC, CCGTTACCACCACTYGGCCGTCG | Schwannomatosis 2 |
| 730880014 | MAFB | NM_005461.4(MAFB): c.161C>T | CCTGCAGCCAGCCGGCTYGGTGT | Multicentric osteolysis nephropathy |
| 387907007 | MAFB | NM_005461.4(MAFB): c.211C>T (p.Pro71Ser) | CCGTGCCCTCGTCGYCCAGCTTC | Multicentric osteolysis nephropathy |
| 387907008 | MAFB | NM_005461.4(MAFB): c.212C>T (p.Pro71Leu) | CCGTGCCCTCGTCGCYCAGCTTC | Multicentric osteolysis nephropathy |
| 398122418 | MAGEL2 | NM_019066.4(MAGEL2): c.3124C>T (p.Arg1042Ter) | CCAAGCCAAGGTGCCTGTCYAGC, CCAAGGTGCCTGTCYAGCGCTCG | Prader-Willi-like syndrome |
| 387906724 | MAGT1 | NM_032121.5(MAGT1): c.409C>T (p.Arg137Ter) | CCTGGCAAACTCCTGGYGATACT | Immunodeficiency, X-linked, with magnesium defect, Epstein-Barr virus infection, and neoplasia |
| 121909494 | MAMLD1 | NM_005491.4(MAMLD1): c.808C>T (p.Gln270Ter) | CCTTCCACCAGTAAGYAGATAGT | Hypospadias 2, X-linked |
| 387906886 | MAN1B1 | NM_016219.4(MAN1B1): c.1000C>T (p.Arg334Cys) | CCTGTTTGAGAGCACGATCYGCA | Mental retardation, autosomal recessive 15 |
| 80338679 | MAN2B1 | NM_000528.3(MAN2B1): c.2165+1G>A | TGGGRGTGAGTGGCACAGGCTGGG, GTGGGRTGAGTGGCACAGGCTGG | Deficiency of alpha-mannosidase |
| 398123455 | MAN2B1 | NM_000528.3(MAN2B1): c.1929G>A (p.Trp643Ter) | TCCAGRTACAACGCCAGTATAGG | not provided |
| 121434332 | MAN2B1 | NM_000528.3(MAN2B1): c.1915C>T (p.Gln639Ter) | CCTGCTGCCTGTTCGCYAGACCT | Deficiency of alpha-mannosidase |
| 730880504 | MAP2K1 | NM_002755.3(MAP2K1): c.412G>A (p.Glu138Lys) | TGGCRAGATCAGTATCTGCATGG | Rasopathy |
| 63750635 | MAPT | NM_016835.4(MAPT): c.1910C>T (p.Ser637Phe) | CCTGAGCAAGGTGACCTYCAAGT | Pick disease, not provided |
| 587777718 | MARS | NM_004990.3(MARS): c.1852C>T (p.Arg618Cys) | CCCTGCTGACATCTGGYGCTTCT, CCTGCTGACATCTGGYGCTTCTA | Charcot-Marie-Tooth disease, CHARCOT-MARIE-TOOTH DISEASE, AXONAL, TYPE 2U |
| 794726870 | MARS2 | NM_138395.3(MARS2): c.424C>T (p.Arg142Trp) | CCGCACCACGGAGGCCYGGCACC | COMBINED OXIDATIVE PHOSPHORYLATION DEFICIENCY 25 |
| 794726869 | MARS2 | NM_138395.3(MARS2): c.550C>T (p.Gln184Ter) | CCTGAGGCCAAGGTCACCYAGCA | COMBINED OXIDATIVE PHOSPHORYLATION DEFICIENCY 25 |
| 118203957 | MARVELD2 | NM_001038603.2 (MARVELD2):c.1498C>T (p.Arg500Ter) | CCACATCATTCGGAAAGCYGACA | Deafness, autosomal recessive 49 |
| 72558181 | MAT1A | NM_000429.2(MAT1A): c.791G>A (p.Arg264His) | CACTGGCCRTAAGATTATTGTGG | Methionine adenosyltransferase deficiency, autosomal dominant |
| 104893640 | MATN3 | NM_002381.4(MATN3): c.209G>A (p.Arg70His) | CCTGGCCRCGCCCGCGGTGCAGG | Multiple epiphyseal dysplasia 5, Multiple Epiphyseal Dysplasia, Dominant |
| 786203385 | MAX | NM_002382.4(MAX): c.295+1G>A | AAGRTGAGCACCCGAGCTCGTGG | Hereditary cancer-predisposing syndrome |
| 1800450 | MBL2 | NM_000242.2(MBL2): c.161G>A (p.Gly54Asp) | ATGRCACCAAGGGAGAAAAGGGG, GATGRCACCAAGGGAGAAAAGGG, TGATGRCACCAAGGGAGAAAAGG | Mannose-binding protein deficiency |
| 5030737 | MBL2 | NM_000242.2(MBL2): c.154C>T (p.Arg52Cys) | CCCAGGCAAAGATGGGYGTGATG, CCAGGCAAAGATGGGYGTGATGG | Mannose-binding protein deficiency |
| 121913557 | MC4R | NM_005912.2(MC4R): c.148G>A (p.Val50Met) | CCTGAGRTGTTTGTGACTCTGGG, TCCTGAGRTGTTTGTGACTCTGG | Obesity |
| 121913563 | MC4R | NM_005912.2(MC4R): c.523G>A (p.Ala175Thr) | TGGCRAGCTTGCACGGTTTCAGG | Obesity |
| 121913567 | MC4R | NM_005912.2(MC4R): c.656C>T (p.Ala219Val) | CCACATGTTCCTGATGGYCAGGC | Obesity |
| 199517715 | MCCC1 | NM_020166.4(MCCC1): c.137G>A (p.Gly46Glu) | CCTTGGTAATGTTTCTTYCTGTT | not provided |
| 387906286 | MCFD2 | NM_001171507.2(MCFD2): c.149+5G>A | TACRTATTCAGCCCGGGCTGTGG | Factor v and factor viii, combined deficiency of, 2 |
| 387906287 | MCFD2 | NM_001171507.2(MCFD2): c.309+1G>A | TAAGGAGRTAGGTCTGGCAGTGG | Factor v and factor viii, combined deficiency of, 2 |
| 28934906 | MECP2 | NM_004992.3(MECP2): c.473C>T (p.Thr158Met) | CCTAATGATTTTGACTTCAYGGT | Angelman syndrome, Rett disorder, Severe neonatal-onset encephalopathy with microcephaly, Autism, susceptibility to, X-linked 3, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61748425 | MECP2 | NM_004992.3(MECP2): c.508C>T (p.Gln170Ter) | CCCCTCCCGGCGAGAGYAGAAAC, CCCTCCCGGCGAGAGYAGAAACC, CCTCCCGGCGAGAGYAGAAACCA | Rett disorder |
| 61749729 | MECP2 | NM_004992.3(MECP2): c.622C>T (p.Gln208Ter) | CCACGTCAGAGGGTGTGYAGGTG | Rett disorder |
| 61749747 | MECP2 | NM_004992.3(MECP2): c.730C>T (p.Gln244Ter) | CCACCACATCCACCYAGGTCATG | Rett disorder, Mental retardation, X-linked, syndromic 13, not provided |
| 61753965 | MECP2 | NM_004992.3(MECP2): c.1216C>T (p.Gln406Ter) | CCAGCCCCCTGAGCCCYAGGAC | Rett disorder, Mental retardation, X-linked, syndromic 13, not provided |
| 397515554 | MED12 | NM_005120.2(MED12): c.2873G>A (p.Gly958Glu) | CATGRGATGAACCGGTCCGATGG | FG syndrome |
| 145770066 | MED25 | NM_030973.3(MED25): c.1004C>T (p.Ala335Val) | CCCCCAGGACCCCCTGGCGYCCC, CCCCAGGACCCCCTGGCGYCCCC, CCCAGGACCCCCTGGCGYCCCCA, CCAGGACCCCCTGGCGYCCCCAA | Charcot-Marie-Tooth disease type 2B2, Charcot-Marie-Tooth disease, not provided |
| 796052724 | MEF2C | NM_002397.4(MEF2C): c.258G>A (p.Glu86=) | TGGARGTGAGAGAGCATGCGTGG | not provided |
| 796052733 | MEF2C | NM_002397.4(MEF2C): c.766C>T (p.Arg256Ter) | CCGTAAACCAGATCTCYGAGTTC | not provided |
| 587783747 | MEF2C | NM_002397.4(MEF2C): c.565C>T (p.Arg189Ter) | CCTGGTGTAACACATYGACCTCC | Mental retardation, stereotypic movements, epilepsy, and/or cerebral malformations |
| 104895085 | MEFV | NM_000243.2(MEFV): c.1958G>A (p.Arg653His) | CCGCCRTTACTGGGAGGTGGAGG, TGGCCGCCRTTACTGGGAGGTGG | Familial Mediterranean fever |
| 28940578 | MEFV | NM_000243.2(MEFV): c.2082G>A (p.Met694Ile) | GATRAGGAAAATGAGTACCAGG | Familial Mediterranean fever, Familial mediterranean fever, autosomal dominant |
| 104895105 | MEFV | NM_000243.2(MEFV): c.1432C>T (p.His478Tyr) | CCTGGAGCAGCAAGAGYATTTCT | Familial Mediterranean fever, Familial mediterranean fever, autosomal dominant |
| 104894257 | MEN1 | NM_130799.2(MEN1): c.594G>A (p.Trp198Ter) | CTGRCACGGCAAGGGCAACGAGG | not provided |
| 104894264 | MEN1 | NM_000244.3(MEN1): c.1267G>A (p.Asp423Asn) | CTACVACGGCATCTGCAAATGGG, TCTACVACGGCATCTGCAAATGG | Multiple endocrine neoplasia, type 1 |
| 794728628 | MEN1 | NM_130799.2(MEN1): c.1186-1G>A | GTCCARGGCACCCAGAGCCAAGG | not provided |
| 386134249 | MEN1 | NM_000244.3(MEN1): c.1277G>A (p.Cys426Tyr) | GGCATCTRCAAATGGGAGGAGGG, CGGCATCTRCAAATGGGAGGAGG | Multiple endocrine neoplasia, type 1, not provided |
| 398124437 | MEN1 | NM_130799.2(MEN1): c.912+1G>A | AAGRTGGGGGCATCTAAGGAGGG, CAAGRTGGGGGCATCTAAGGAGG, CCACAAGRTGGGGGCATCTAAGG | not provided |
| 28931612 | MEN1 | NM_000244.3(MEN1): c.76G>A (p.Glu26Lys) | TGCTGCCDAGCTGGGCCGAGAGG | |
| 794728614 | MEN1 | NM_130799.2(MEN1): c.35C>T (p.Pro12Leu) | CCCAGAAGACGCTGTTCCYGCTG, CCAGAAGACGCTGTTCCYGCTGC | not provided |
| 794728620 | MEN1 | NM_130799.2(MEN1): c.652C>T (p.Arg218Trp) | CCGGTGTGGCTGAGYGGGTATTG | not provided |
| 794728631 | MEN1 | NM_130799.2(MEN1): c.1660C>T (p.Gln554Ter) | CCAGTGCTCACTTTCYAGAGTGA | not provided |
| 794728647 | MEN1 | NM_130799.2(MEN1): c.322C>T (p.Arg108Ter) | CCTGTCCCTCTATCCYTGAGAAG | not provided |
| 794728654 | MEN1 | NM_130799.2(MEN1): c.1324C>T (p.Gln442Ter) | CCACCTTTCTTGTGYAGTCCCTA | not provided |
| 119489105 | MERTK | NM_006343.2(MERTK): c.1951C>T (p.Arg651Ter) | CCACCCAAATGTCATTYGACTTC | Retinitis pigmentosa 38 |
| 587777646 | METTL23 | NM_001080510.4 (METTL23):c.397C>T (p.Gln133Ter) | CCAATTGTGGTCTACTTATYAAG | Mental retardation, autosomal recessive 44 |
| 727502791 | MFAP5 | NM_003480.3(MFAP5): c.472C>T | CCGTCGCTCCAATTACTTCYGAC | Aortic aneurysm, familial thoracic 9 |
| 28940291 | MFN2 | NM_014874.3(MFN2): c.281G>A (p.Arg94Gln) | GGCTCRGAGGCACATGAAAGTGG | Charcot-Marie-Tooth disease, type 2A2 |
| 28940294 | MFN2 | NM_014874.3(MFN2): c.839G>A (p.Arg280His) | GGAGCRTTGTACCAGCTTCCTGG | Charcot-Marie-Tooth disease, type 2A2 |
| 138382758 | MFN2 | NM_014874.3(MFN2): c.1403G>A (p.Arg468His) | CTGCACCRCCACATAGAGGAAGG | Charcot-Marie-Tooth disease, type 2A2, not specified |
| 119103266 | MFN2 | NM_014874.3(MFN2): c.617C>T (p.Thr206Ile) | CCCTGGTATTGATGTCAYCACAG, CCTGGTATTGATGTCAYCACAGA | Hereditary motor and sensory neuropathy with optic atrophy |
| 387906991 | MFN2 | NM_014874.3(MFN2): c.1085C>T (p.Thr362Met) | CCAAGTTTGAGCAGCACAYGGTC | Charcot-Marie-Tooth disease, type 2A2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267607235 | MFSD8 | NM_152778.2(MFSD8): c.1235C>T (p.Pro412Leu) | CCTGGTGCCTCTACACCCYGGTG | Ceroid lipofuscinosis neuronal 7 |
| 104894446 | MGAT2 | NM_002408.3(MGAT2): c.869C>T (p.Ser290Phe) | CCTGAATGTGATGTTCTCTYCCT | Carbohydrate-deficient glycoprotein syndrome type II |
| 587776943 | MGME1 | NM_001310338.1(MGME1): c.456G>A (p.Trp152Ter) | GTGRAAACAGCGGATGATTCTGG | Mitochondrial DNA depletion syndrome 11 |
| 119486096 | MINPP1 | NM_004897.4(MINPP1): c.122C>T (p.Ser41Leu) | CCGAGGGACCCGGTGGCCTYGTC | Thyroid cancer, follicular |
| 281797258 | MKKS | NM_170784.2(MKKS): c.250C>T (p.His84Tyr) | TGACACATRATTCTGTATGGAGG | McKusick Kaufman syndrome |
| 80358245 | MLC1 | NM_015166.3(MLC1): c.278C>T (p.Ser93Leu) | CCAGTGCATCCCCTYGGCAATTG | Megalencephalic leukoencephalopathy with subcortical cysts 1 |
| 121908341 | MLC1 | NM_015166.3(MLC1): c.839C>T (p.Ser280Leu) | CCTCTGGATATCTGTYATTCAGC | Megalencephalic leukoencephalopathy with subcortical cysts 1 |
| 63750604 | MLH1 | NM_000249.3(MLH1): c.1790G>A (p.Trp597Ter) | AGTGGCTRGACAGAGGAAGATGG | Hereditary Nonpolyposis Colorectal Neoplasms |
| 587779021 | MLH1 | NM_000249.3(MLH1): c.545G>A (p.Arg182Lys) | GCARGTACAGTCCAAAATCTGGG, GGCARGTACAGTCCAAAATCTGG | Hereditary Nonpolyposis Colorectal Neoplasms |
| 63749820 | MLH1 | NM_000249.3(MLH1): c.436C>T (p.Gln146Ter) | CCATGTGCTGGCAATYAAGGGAC | Hereditary Nonpolyposis Colorectal Neoplasms |
| 63749950 | MLH1 | NM_000249.3(MLH1): c.842C>T (p.Ala281Val) | CCATAGAAACAGTGTATGYAGCC | Hereditary Nonpolyposis Colorectal Neoplasms |
| 63750192 | MLH1 | NM_000249.3(MLH1): c.1624C>T (p.Gln542Ter) | CCTCAGTGGGCCTTGGCAYAGCA | Hereditary Nonpolyposis Colorectal Neoplasms |
| 63750726 | MLH1 | NM_000249.3(MLH1): c.1961C>T (p.Pro654Leu) | CCCCCTTTGGAGGGACTGCYTAT, CCCCTTTGGAGGGACTGCYTATC, CCCTTTGGAGGGACTGCYTATCT, CCTTTGGAGGGACTGCYTATCTT | Hereditary Nonpolyposis Colorectal Neoplasms |
| 63751109 | MLH1 | NM_000249.3(MLH1): c.131C>T (p.Ser44Phe) | CCAGTTTAGATGCAAAATYCACA | Hereditary Nonpolyposis Colorectal Neoplasms, Lynch syndrome II |
| 63751153 | MLH1 | NM_000249.3(MLH1): c.1225C>T (p.Gln409Ter) | CCCCTGTCCAGTCAGCCCYAGGC, CCCTGTCCAGTCAGCCCYAGGCC, CCTGTCCAGTCAGCCCYAGGCCA | Hereditary Nonpolyposis Colorectal Neoplasms |
| 63751310 | MLH1 | NM_000249.3(MLH1): c.1975C>T (p.Arg659Ter) | CCTATCTTCATTCTTYGACTAGC | Hereditary Nonpolyposis Colorectal Neoplasms, Hereditary cancer-predisposing syndrome, not provided |
| 587779058 | MLH1 | NM_000249.3(MLH1): c.982C>T (p.Gln328Ter) | CCTGGAGCGGGTGCAGYAGCACA | Hereditary Nonpolyposis Colorectal Neoplasms, Hereditary cancer-predisposing syndrome |
| 119473031 | MLPH | NM_024101.6(MLPH): c.103C>T (p.Arg35Trp) | CCGAAGGAAAGAAGAGGAAYGGC | Griscelli syndrome type 3 |
| 369296618 | MMAB | NM_052845.3(MMAB): c.700C>T (p.Gln234Ter) | CTCTTRATTCCCCTCCTTCATGG | Methylmalonic aciduria cblB type, not provided |
| 756414548 | MMAB | NM_052845.3(MMAB): c.569G>A (p.Arg190His) | CCGTCTCTCGGCCCGGYGGCACA | not provided |
| 796051996 | MMACHC | NM_015506.2(MMACHC): c.420G>A (p.Trp140Ter) | CATGRGGGAACCAGGTGAGAGGG, CCATGRGGGAACCAGGTGAGAGG | Methylmalonic acidemia with homocystinuria, not provided |
| 796051997 | MMACHC | NM_015506.2(MMACHC): c.600G>A (p.Trp200Ter) | CTGRCGTGATTGGACTTACCGGG, ACTGRCGTGATTGGACTTACCGG | not provided |
| 121912955 | MMP2 | NM_004530.5(MMP2): c.1210G>A (p.Glu404Lys) | CACRAGTTTGGCCACGCCATGGG, CCACRAGTTTGGCCACGCCATGG | Multicentric osteolysis, nodulosis and arthropathy |
| 104893969 | MOCS1 | NM_001075098.3(MOCS1): c.956G>A (p.Arg319Gln) | GCCTGCRAATCACAGCTGATGG, CGCCTGCRAATCACAGCTGATGG | Molybdenum cofactor deficiency, complementation group A |
| 104893970 | MOCS1 | NM_001075098.3(MOCS1): c.217C>T (p.Arg73Trp) | CCGGCAGCACAGCTACCTYGGA | Molybdenum cofactor deficiency, complementation group A |
| 387907237 | MPC1 | NM_016098.3(MPC1): c.289C>T (p.Arg97Trp) | CCAGCTCATCCAGGGAGGYGGC | Mitochondrial pyruvate carrier deficiency |
| 104894489 | MPI | NM_002435.2(MPI): c.656G>A (p.Arg219Gln) | AAGCRGATCTCCCAGCAAGGTGG, GTGAAGCRGATCTCCCAGCAAGG | Congenital disorder of glycosylation type 1B |
| 104894494 | MPI | NM_002435.2(MPI): c.305C>T (p.Ser102Leu) | CCTCTTCAAAGTGCTCTYAGTTG | Congenital disorder of glycosylation type 1B |
| 121913611 | MPL | NM_005373.2(MPL): c.769C>T (p.Arg257Cys) | CCTACTGGCTGCAGCTGYGCAGC | Congenital amegakaryocytic thrombocytopenia |
| 28730837 | MPO | NM_000250.1(MPO): c.995C>T (p.Ala332Val) | CCGCAACCAGATCAACGYGCTCA | Myeloperoxidase deficiency |
| 121909721 | MPV17 | NM_002437.4(MPV17): c.149G>A (p.Arg50Gln) | GAGAGGCCRGACTCTGACCATGG | Navajo neurohepatopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909724 | MPV17 | NM_002437.4(MPV17): c.359G>A (p.Trp120Ter) | CAACTRGGCCAAACTACAGCGGG, ACAACTRGGCCAAACTACAGCGG | Navajo neurohepatopathy |
| 267607261 | MPV17 | NM_002437.4(MPV17): c.206G>A (p.Trp69Ter) | GCTRGTACAAGGTTTTGGATCGG, AGGAGGCTRGTACAAGGTTTTGG | Navajo neurohepatopathy |
| 267607258 | MPV17 | NM_002437.4(MPV17): c.293C>T (p.Pro98Leu) | CCCTAGGGGGGCTTTGCCCYGTG, CCTAGGGGGGCTTTGCCCYGTGT | Navajo neurohepatopathy, not provided |
| 121913588 | MPZ | NM_000530.6(MPZ): c.409G>A (p.Gly137Ser) | CATAGTGRGCAAGACCTCTCAGG | Charcot-Marie-Tooth disease type 1B |
| 121913600 | MPZ | NM_000530.6(MPZ): c.308G>A (p.Gly103Glu) | GGTAGRGGACCCTCGCTGGAAGG | Charcot-Marie-Tooth disease type 1B |
| 121913598 | MPZ | NM_000530.6(MPZ): c.131C>T (p.Ser44Phe) | CCATGGTGCTGTGGGCTYCCGGG | Charcot-Marie-Tooth disease type 21, Charcot-Marie-Tooth disease type 1B |
| 137852761 | MRE11A | NM_005591.3(MRE11A): c.1714C>T (p.Arg572Ter) | CCAACAAAGGAAGAGGCYGAGGA | Hereditary cancer-predisposing syndrome, Ataxia-telangiectasia-like disorder |
| 63750396 | MSH2 | NM_000251.2(MSH2): c.1035G>A (p.Trp345Ter) | GTGRATTAAGCAGCCTCTCATGG | Hereditary Nonpolyposis Colorectal Neoplasms, not provided |
| 63750466 | MSH2 | NM_000251.2(MSH2): c.4G>A (p.Ala2Thr) | CGACATGRCGGTGCAGCCGAAGG | Hereditary Nonpolyposis Colorectal Neoplasms, Hereditary cancer-predisposing syndrome, not specified, not provided |
| 63750624 | MSH2 | NM_000251.2(MSH2): c.484G>A (p.Gly162Arg) | ACAGGTTRGAGTTGGGTATGTGG | Hereditary Nonpolyposis Colorectal Neoplasms |
| 63749917 | MSH2 | NM_000251.2(MSH2): c.2446C>T (p.Gln816Ter) | CCTTAACTATGCTTTATYAGGTG | Hereditary Nonpolyposis Colorectal Neoplasms |
| 63750203 | MSH2 | NM_000251.2(MSH2): c.1885C>T (p.Gln629Ter) | CCATTTTGGAGAAAGGAYAAGGA | Hereditary Nonpolyposis Colorectal Neoplasms |
| 63750302 | MSH2 | NM_000251.2(MSH2): c.1183C>T (p.Gln395Ter) | CCGACTTGCCAAGAAGTTTYAAA | Hereditary Nonpolyposis Colorectal Neoplasms |
| 63750488 | MSH2 | NM_000251.2(MSH2): c.715C>T (p.Gln239Ter) | CCACAAAGACATTTATYAGGAC | Hereditary Nonpolyposis Colorectal Neoplasms |
| 63750951 | MSH2 | NM_000251.2(MSH2): c.181C>T (p.Gln61Ter) | CCGGGAGGTGTTCAAGACCYAGG | Hereditary Nonpolyposis Colorectal Neoplasms, not provided |
| 63751226 | MSH2 | NM_000251.2(MSH2): c.472C>T (p.Gln158Ter) | CCGCAGTTGATGGCYAGAGACAG | Hereditary Nonpolyposis Colorectal Neoplasms |
| 28929483 | MSH2 | NM_000251.2(MSH2): c.1865C>T (p.Pro622Leu) | CCTGTTCCATATGTACGACYAGC | Hereditary Nonpolyposis Colorectal Neoplasms, Lynch syndrome I |
| 146816935 | MSH6 | NM_000179.2(MSH6): c.892C>T (p.Arg298Ter) | CCCTGTCAAAGTTGCTYGAAAGC, CCTGTCAAAGTTGCTYGAAAGCG | Hereditary Nonpolyposis Colorectal Neoplasms, Hereditary cancer-predisposing syndrome, not provided |
| 63750563 | MSH6 | NM_000179.2(MSH6): c.3013C>T (p.Arg1005Ter) | CCAAGAAGGGCTGTAAAYGATAC | Hereditary Nonpolyposis Colorectal Neoplasms, not provided |
| 587779212 | MSH6 | NM_000179.2(MSH6): c.1483C>T (p.Arg495Ter) | CCAGAAATGATGGAGGCAYGATG | Hereditary Nonpolyposis Colorectal Neoplasms, Hereditary cancer-predisposing syndrome, not provided |
| 267606883 | MT-001 | m.6328C>T | CCCACCCTGGAGCCTYCGTAGAC, CCACCCTGGAGCCTYCGTAGACC | Cytochrome c oxidase i deficiency |
| 200613617 | MT-OO3 | m.9804G>A | TTTGTARCCACAGGCTTCCACGG | Leber optic atrophy |
| 267606611 | MT-OO3 | m.9438G>A | TCCAAAAARGCCTTCGATACGGG | Leber optic atrophy |
| 207459995 | MT-CYB | m.14985G>A | ATCCRCTACCTTCACGCCAATGG | Familial colorectal cancer |
| 199795644 | MT-CYB | m.14831G>A | ATCTCCRCATGATGAAACTTCGG | Leber optic atrophy |
| 397515612 | MT-ND1 | m.3376G>A | CTTACCRAACGAAAAATTCTAGG | Leber optic atrophy |
| 199476115 | MT-ND2 | m.5244G>A | AACCRGCTTTTTGCCCAAATGGG, TAACCRGCTTTTTGCCCAAATGG | Leber optic atrophy |
| 121434457 | MT-TA | m.5650G>A | TAARCCCTTACTAGACCAATGGG, CTAARCCCTTACTAGACCAATGG | |
| 118203886 | MT-TF | m.611G>A | TACACTRAAATGTTTAGACGGG, ATACACTRAAATGTTTAGACGG | Myoclonus with epilepsy with ragged red fibers |
| 199476130 | MT-TN | m.5703G>A | AGCTAARCACCCTAATCAACTGG | |
| 587777418 | MTFMT | NM_139242.3(MTFMT): c.878G>A (p.Ser293Asn) | CCAGCAAGGACTGAAYTGTTAAC | Combined oxidative phosphorylation deficiency 15 |
| 786204030 | MTHFR | NM_005957.4(MTHFR): c.1683G>A (p.Trp561Ter) | TCACTTGRGGCATCTTCCCTGGG, GTCACTTGRGGCATCTTCCCTGG | Homocysteinemia due to MTHFR deficiency |
| 786204023 | MTHFR | NM_005957.4(MTHFR): c.1088G>A (p.Arg363His) | AGATGTACRTCCCATCTTCTGGG | Homocysteinemia due to MTHFR deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 45590836 | MTHFR | NM_005957.4(MTHFR): c.1743G>A (p.Met581Ile) | CTTCATRTTCTGGAAGGTAAAGG | Homocysteinemia due to MTHFR deficiency |
| 769381688 | MTHFR | NM_005957.4(MTHFR): c.379C>T (p.His127Tyr) | TCATGTRCAGGATGGTCTCCAGG | Homocysteinemia due to MTHFR deficiency |
| 786204009 | MTHFR | NM_005957.4(MTHFR): c.244C>T (p.Arg82Trp) | CCCCCTACAGGTTTGACYGGATG, CCCCTACAGGTTTGACYGGATGG, CCCTACAGGTTTGACYGGATGGC, CCTACAGGTTTGACYGGATGGCA | Homocysteinemia due to MTHFR deficiency |
| 786204021 | MTHFR | NM_005957.4(MTHFR): c.1042C>T (p.Pro348Ser) | CCCAGGCGTCCCCTAYCCTGGGC, CCAGGCGTCCCCTAYCCTGGGCT | Homocysteinemia due to MTHFR deficiency |
| 786204022 | MTHFR | NM_005957.4(MTHFR): c.1060C>T (p.His354Tyr) | CCCTGGGCTCTCAGCGCCYACCC, CCTGGGCTCTCAGCGCCYACCCC | Homocysteinemia due to MTHFR deficiency |
| 367585605 | MTHFR | NM_005957.4(MTHFR): c.1320G>A (p.Ser440=) | CCGGTTTGGTTCTCCYGAGAGGT | Homocysteinemia due to MTHFR deficiency |
| 777661576 | MTHFR | NM_005957.4(MTHFR): c.1753-18G>A | CCTACACACACATACCCCYGCAC | Homocysteinemia due to MTHFR deficiency |
| 776483190 | MTHFR | NM_005957.4(MTHFR): c.137G>A (p.Arg46Gln) | CCGCCTCATCTTCTCCYGGAGTC | Homocysteinemia due to MTHFR deficiency |
| 121434294 | MTHFR | NM_005957.4(MTHFR): c.547C>T (p.Arg183Ter) | CCTGGTGAAGCACATCYGAAGTG | Homocystinuria due to MTHFR deficiency |
| 121434296 | MTHFR | NM_005957.4(MTHFR): c.1129C>T (p.Arg377Cys) | CCAAAGAGTTACATCTACYGTAC | Homocystinuria due to MTHFR deficiency |
| 132630307 | MTM1 | NM_000252.2(MTM1): c.469G>A (p.Glu157Lys) | GAARAAAAGTTTAACGTGGATGG, AAATGAARAAAAGTTTAACGTGG | Severe X-linked myotubular myopathy |
| 587783778 | MTM1 | NM_000252.2(MTM1): c.1337G>A (p.Trp446Ter) | TGTGTRGCAAATGTCAAAACAGG | Severe X-linked myotubular myopathy |
| 587783779 | MTM1 | NM_000252.2(MTM1): c.1353+1G>A | AAAACAGRTAAGGAATATGAGGG, CAAAACAGRTAAGGAATATGAGG | Severe X-linked myotubular myopathy |
| 587783846 | MTM1 | NM_000252.2(MTM1): c.64-1G>A | TGTTTCTARACGTCTCGAGATGG | Severe X-linked myotubular myopathy |
| 587783832 | MTM1 | NM_000252.2(MTM1): c.535C>T (p.Pro179Ser) | CCTCACAGGGCTTGYCCAATCAC | Severe X-linked myotubular myopathy |
| 587783836 | MTM1 | NM_000252.2(MTM1): c.557C>T (p.Thr186Ile) | CCATTGGAGAATAAYTTTTATTA | Severe X-linked myotubular myopathy |
| 587783841 | MTM1 | NM_000252.2(MTM1): c.614C>T (p.Pro205Leu) | CCTGCTCTTTTGGTGGTTCYGTA | Severe X-linked myotubular myopathy |
| 587783845 | MTM1 | NM_000252.2(MTM1): c.637C>T (p.Leu213Phe) | CCTCAGATGATGACYTCCGGAGA | Severe X-linked myotubular myopathy |
| 137853061 | MTRR | NM_002454.2(MTRR): c.1459G>A (p.Gly487Arg) | GGAAGRGAGTATGTACAGGCTGG | Homocystinuria-Megaloblastic anemia due to defect in cobalamin metabolism, cblE complementation type |
| 121918248 | MUT | NM_000255.3(MUT): c.52C>T (p.Gln18Ter) | CCTCATTACCTGAGGYAGGTAAA | METHYLMALONIC ACIDURIA, mut(0) TYPE |
| 398123278 | MUT | NM_000255.3(MUT): c.91C>T (p.Arg31Ter) | CCAGGCTCATACAGCAAYGACTT | Methylmalonic aciduria due to methylmalonyl-CoA mutase deficiency, not provided |
| 36053993 | MUTYH | NM_001128425.1(MUTYH): c.1187G>A (p.Gly396Asp) | CAGRTCTGCTGGCAGGACTGTGG | MYH-associated polyposis, Hereditary cancer-predisposing syndrome, Endometrial carcinoma, Carcinoma of colon, not specified, not provided |
| 587781337 | MUTYH | NM_001128425.1(MUTYH): c.1186+1G>A | AACTCAGRTACCTGGATACTGGG, CAACTCAGRTACCTGGATACTGG | Hereditary cancer-predisposing syndrome |
| 748170941 | MUTYH | NM_001128425.1(MUTYH): c.309G>A (p.Trp103Ter) | CCCGTTTCTCTTGGTCGTAYCAG, CCGTTTCTCTTGGTCGTAYCAGC | MYH-associated polyposis, Hereditary cancer-predisposing syndrome |
| 140342925 | MUTYH | NM_001128425.1(MUTYH): c.734G>A (p.Arg245His) | CCAATGGCTCGGACAYGGCACAG | MYH-associated polyposis, Hereditary cancer-predisposing syndrome |
| 587780082 | MUTYH | NM_001128425.1(MUTYH): c.1012C>T (p.Gln338Ter) | CCCAGCTCCCAACACTGGAYAGT, CCAGCTCCCAACACTGGAYAGTG | Hereditary cancer-predisposing syndrome |
| 587781338 | MUTYH | NM_001128425.1(MUTYH): c.940C>T (p.Gln314Ter) | CCTCTCAGGTGGAGYAGGAACAG | Hereditary cancer-predisposing syndrome |
| 372267274 | MUTYH | NM_001128425.1(MUTYH): c.389-1G>A | CCTCTGAGACCCACAYTGGGGGA | Hereditary cancer-predisposing syndrome |
| 587783057 | MUTYH | NM_001128425.1(MUTYH): c.1171C>T (p.Gln391Ter) | CCCAAATTCTGCTGGTGYAGAGG, CCAAATTCTGCTGGTGYAGAGGC | Carcinoma of colon |
| 104895317 | MVK | NM_000431.3(MVK): c.1000G>A (p.Ala334Thr) | GGCRCAGGCGGTGGTGGCTGTGG | Hyperimmunoglobulin D with periodic fever, Mevalonic aciduria |
| 104895319 | MVK | NM_000431.3(MVK): c.928G>A (p.Val310Met) | CGGCRTGGGCCACGCCTCTCTGG | Hyperimmunoglobulin D with periodic fever, Mevalonic aciduria |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852604 | MXI1 | NM_130439.3(MXI1): c.362C>T (p.Ala121Val) | CCACGGAGGTTGAGCCGGGYACA | Neurofibrosarcoma |
| 36211723 | MYBPC3 | NM_000256.3(MYBPC3): c.2308G>A (p.Asp770Asn) | GTCATCRGTGAGGCCGGCCGGGG, GGTCATCRGTGAGGCCGGCCGGG, AGGTCATCRGTGAGGCCGGCCGG | Primary familial hypertrophic cardiomyopathy, Familial hypertrophic cardiomyopathy 4, Cardiomyopathy |
| 727505266 | MYBPC3 | NM_000256.3(MYBPC3): c.1219G>A (p.Gly407Ser) | TGAGCRGCAGGTGCAGCCTGGGG, ATGAGCRGCAGGTGCAGCCTGGG, GATGAGCRGCAGGTGCAGCCTGG | Cardiomyopathy, not specified |
| 730880597 | MYBPC3 | NM_000256.3(MYBPC3): c.3641G>A (p.Trp1214Ter) | TTCCTRGTTCAAGAATGGCCTGG | Cardiomyopathy |
| 397515903 | MYBPC3 | NM_000256.3(MYBPC3): c.1458-1G>A | GGCTARGCTGAAGGACGGGGTGG, CCCGGCTARGCTGAAGGACGGGG | Familial hypertrophic cardiomyopathy 4, Cardiomyopathy |
| 397515935 | MYBPC3 | NM_000256.3(MYBPC3): c.1897+1G>A | TCATGGRTGAGCCTGCTCCAGGG, TTCATGGRTGAGCCTGCTCCAGG | Familial hypertrophic cardiomyopathy 4, Cardiomyopathy |
| 397515982 | MYBPC3 | NM_000256.3(MYBPC3): c.2670G>A (p.Trp890Ter) | GTGRCGGCCCCCAGAGCGCGTGG | Familial hypertrophic cardiomyopathy 4, Cardiomyopathy, Hypertrophic cardiomyopathy |
| 397516006 | MYBPC3 | NM_000256.3(MYBPC3): c.3233G>A (p.Trp1078Ter) | TGACGCCTRGGGTCTTAATGTGG | Familial hypertrophic cardiomyopathy 4 |
| 397516031 | MYBPC3 | NM_000256.3(MYBPC3): c.3627+1G>A | GCCCCAAGRTAGGGAACTTTAGG | Familial hypertrophic cardiomyopathy 4, Cardiomyopathy |
| 397516041 | MYBPC3 | NM_000256.3(MYBPC3): c.3797G>A (p.Cys1266Tyr) | GAGTRCCGCCTGGAGGTGCGAGG | Familial hypertrophic cardiomyopathy 4, Cardiomyopathy |
| 397516044 | MYBPC3 | NM_000256.3(MYBPC3): c.3815-1G>A | TCTGCARTGCCTCAGTGACCAGG | Familial hypertrophic cardiomyopathy 4, Cardiomyopathy |
| 397516074 | MYBPC3 | NM_000256.3(MYBPC3): c.772G>A (p.Glu258Lys) | TGTCCACRGTGAGGGGCCCTGG | Primary familial hypertrophic cardiomyopathy, Familial hypertrophic cardiomyopathy 4, Cardiomyopathy |
| 193922377 | MYBPC3 | NM_000256.3(MYBPC3): c.1321G>A (p.Glu441Lys) | GGGTGGCRAGAAGTGTAGCACGG | Primary familial hypertrophic cardiomyopathy, Cardiomyopathy, not specified |
| 727503167 | MYBPC3 | NM_000256.3(MYBPC3): c.3763G>A (p.Ala1255Thr) | TGCAGGRCCACCAACTTACAGGG, CTGCAGGRCCACCAACTTACAGG | Cardiomyopathy, not specified |
| 727503195 | MYBPC3 | NM_000256.3(MYBPC3): c.1790G>A (p.Arg597Gln) | GGGCRGTGAGTGTGCAGGGCAGG, CATCGGGCRGTGAGTGTGCAGGG | Familial hypertrophic cardiomyopathy 4, Cardiomyopathy, not specified |
| 727503204 | MYBPC3 | NM_000256.3(MYBPC3): c.1351+1G>A | AAAGRTGGGCCTGGGACCTGAGG | Familial hypertrophic cardiomyopathy 4 |
| 727503211 | MYBPC3 | NM_000256.3(MYBPC3): c.966G>A (p.Trp322Ter) | CGTGTGRGAGATCCTACGGCAGG | Familial hypertrophic cardiomyopathy 4 |
| 727504276 | MYBPC3 | NM_000256.3(MYBPC3): c.3335G>A (p.Trp1112Ter) | CCAGGAGTRGTTCACCGTCTTGG | Familial hypertrophic cardiomyopathy 4 |
| 727504305 | MYBPC3 | NM_000256.3(MYBPC3): c.3331-1G>A | CCARGAGTGGTTCACCGTCTTGG | Familial hypertrophic cardiomyopathy 4 |
| 727504334 | MYBPC3 | NM_000256.3(MYBPC3): c.2149-1G>A | CCARCTGCTGTGTGAGACCGAGG | Familial hypertrophic cardiomyopathy 4 |
| 727504349 | MYBPC3 | NM_000256.3(MYBPC3): c.2747G>A (p.Trp916Ter) | AGTRGGTGGCTGCCCTGCAGGGG, GAGTRGGTGGCTGCCCTGCAGGG, AGAGTRGGTGGCTGCCCTGCAGG | Familial hypertrophic cardiomyopathy 4 |
| 730880542 | MYBPC3 | NM_000256.3(MYBPC3): c.1457G>A (p.Trp486Ter) | AATRGTGAGTTCCAGAAGCACGG | Cardiomyopathy |
| 730880546 | MYBPC3 | NM_000256.3(MYBPC3): c.1731G>A (p.Trp577Ter) | TGTGTGRCTGAAGAATGGGAAGG | Cardiomyopathy |
| 730880576 | MYBPC3 | NM_000256.3(MYBPC3): c.2748G>A (p.Trp916Ter) | AGTGRGTGGCTGCCCTGCAGGGG, GAGTGRGTGGCTGCCCTGCAGGG, AGAGTGRGTGGCTGCCCTGCAGG | Cardiomyopathy |
| 730880584 | MYBPC3 | NM_000256.3(MYBPC3): c.2995-1G>A | TCARGGCAAGCCCCGGCCTCAGG | Cardiomyopathy |
| 730880639 | MYBPC3 | NM_000256.3(MYBPC3): c.1223+1G>A | GGCAGRTGCAGCCTGGGGTGGGG, CGGCAGRTGCAGCCTGGGGTGGG, GCGGCAGRTGCAGCCTGGGGTGG | Cardiomyopathy |
| 730880691 | MYBPC3 | NM_000256.3(MYBPC3): c.1624+5G>A | CAGGGTGARCCTGGCTGGGGGGG | Cardiomyopathy |
| 373056282 | MYBPC3 | NM_000256.3(MYBPC3): c.2882C>T (p.Pro961Leu) | ACCRGCTCCGTGGTGGTAACAGG | Primary familial hypertrophic cardiomyopathy, Cardiomyopathy, not specified |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515895 | MYBPC3 | NM_000256.3(MYBPC3): c.1273C>T (p.Gln425Ter) | CCCTGACCATCAGCYAGTGCTCA | Familial hypertrophic cardiomyopathy 4 |
| 397516005 | MYBPC3 | NM_000256.3(MYBPC3): c.3181C>T (p.Gln1061Ter) | CCACGCTGGTGCTGYAGGTTGTT | Primary familial hypertrophic cardiomyopathy, Familial hypertrophic cardiomyopathy 4, Cardiomyopathy |
| 397516037 | MYBPC3 | NM_000256.3(MYBPC3): c.3697C>T (p.Gln1233Ter) | CCGCATGTTCAGCAAGYAGGGAG | Familial hypertrophic cardiomyopathy 4, Cardiomyopathy, Hypertrophic cardiomyopathy |
| 397516061 | MYBPC3 | NM_000256.3(MYBPC3): c.613C>T (p.Gln205Ter) | CCTGAGCAGCAAGGTGGGCYAGC | Familial hypertrophic cardiomyopathy 4, Cardiomyopathy |
| 199865688 | MYBPC3 | NM_000256.3(MYBPC3): c.2497G>A (p.Ala833Thr) | CCCTCGATCATGCGCCGCYTTC, CCTCGATCATGCGCCGCYTTCA | Primary dilated cardiomyopathy, Primary familial hypertrophic cardiomyopathy, Familial hypertrophic cardiomyopathy 4, Left ventricular noncompaction 10, Cardiomyopathy, Paroxysmal atrial fibrillation, not specified |
| 200625851 | MYBPC3 | NM_000256.3(MYBPC3): c.1468G>A (p.Gly490Arg) | CCCGGGTCAGCTCCACCCYGTCC, CCGGGTCAGCTCCACCCYGTCCT | Primary familial hypertrophic cardiomyopathy, Familial hypertrophic cardiomyopathy 4, Left ventricular noncompaction 10, Cardiomyopathy, not specified |
| 727503216 | MYBPC3 | NM_000256.3(MYBPC3): c.557C>T (p.Pro186Leu) | CCAGCCTCCTGAAGCYGCCTGTG | Cardiomyopathy, not specified |
| 727504234 | MYBPC3 | NM_000256.3(MYBPC3): c.844C>T (p.Arg282Trp) | CCTGGCTGGAGGTGGTCGGYGGA | Familial hypertrophic cardiomyopathy 4, not specified |
| 730880544 | MYBPC3 | NM_000256.3(MYBPC3): c.1522C>T (p.Gln508Ter) | CCGGTTCAAGAAGGACGGGYAGA | Cardiomyopathy |
| 730880552 | MYBPC3 | NM_000256.3(MYBPC3): c.1822C>T (p.Pro608Ser) | CCATTGACGACGTCACAYCTGCC | Cardiomyopathy |
| 730880586 | MYBPC3 | NM_000256.3(MYBPC3): c.3034C>T (p.Gln1012Ter) | CCTGGACCAAAGAGGGGYAGCCC | Cardiomyopathy |
| 730880618 | MYBPC3 | NM_000256.3(MYBPC3): c.484C>T (p.Gln162Ter) | CCTCTTCGTGATGCGGCCAYAGG | Familial hypertrophic cardiomyopathy 4, Cardiomyopathy |
| 730880699 | MYBPC3 | NM_000256.3(MYBPC3): c.3553C>T (p.Gln1185Ter) | CCCCAAGCTTCACCYAGCCCCTG | Cardiomyopathy |
| 368765949 | MYBPC3 | NM_000256.3(MYBPC3): c.3642G>A (p.Trp1214Ter) | CCAGGCCATTCTTGAAYCAGGAA | Familial hypertrophic cardiomyopathy 4, Cardiomyopathy, not provided |
| 371488302 | MYBPC3 | NM_000256.3(MYBPC3): c.2311G>A (p.Val771Met) | CCGCAGGTGCGTCTGGCAYGTCT | Primary dilated cardiomyopathy, Primary familial hypertrophic cardiomyopathy, Cardiomyopathy |
| 387907267 | MYBPC3 | NM_000256.3(MYBPC3): c.2827C>T (p.Arg943Ter) | CCCGGCTGCTTTTCYGAGTGCGG | Familial hypertrophic cardiomyopathy 4, Cardiomyopathy |
| 104893646 | MYCN | NM_005378.5(MYCN): c.1178G>A (p.Arg393His) | GCCAGCRCCGCAACGACCTTCGG | Feingold syndrome 1 |
| 267606902 | MYH11 | NM_022844.2(MYH11): c.2135G>A (p.Arg712Gln) | GCCRGCAGGGCTTCCCCAACCGG | Aortic aneurysm, familial thoracic 4, Thoracic aortic aneurysms and aortic dissections |
| 28940306 | MYH14 | NM_001145809.1(MYH14): c.3049C>T (p.Leu1017Phe) | CCAGGAGCTAGAGGCCCACYTTG | Deafness, autosomal dominant 4 |
| 119103281 | MYH14 | NM_001145809.1(MYH14): c.359C>T (p.Ser120Leu) | CCTGCCTCAACGAGGCCTYGGTC, CCTCAACGAGGCCTYGGTCCTGC | Deafness, autosomal dominant 4 |
| 121913623 | MYH3 | NM_002470.3(MYH3): c.700G>A (p.Ala234Thr) | TTGGGAACRCCAAGACTGTGAGG | Distal arthrogryposis type 2B |
| 121913619 | MYH3 | NM_002470.3(MYH3): c.533C>T (p.Thr178Ile) | CCAGTCCATTCTGATCAYGTAAG | Freeman-Sheldon syndrome, Distal arthrogryposis type 2B |
| 36211715 | MYH7 | NM_000257.3(MYH7): 09G>A (p.Arg870His) | GGCTCGCCRCAAGGAGCTGGAGG | Primary familial hypertrophic cardiomyopathy, Familial hypertrophic cardiomyopathy 1, Cardiomyopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 45520836 | MYH7 | NM_000257.3(MYH7): c.5588G>A (p.Arg1863Gln) | CCTGCTGCRGCTGCAGGACCTGG | Cardiomyopathy, not specified |
| 372381770 | MYH7 | NM_000257.3(MYH7): c.5561C>T (p.Thr1854Met) | TCCTCCRTCTGGGGGCCAGAGGG, CTCCTCCRTCTGGGGGCCAGAGG | Primary familial hypertrophic cardiomyopathy, Cardiomyopathy, not specified |
| 3218713 | MYH7 | NM_000257.3(MYH7): c.746G>A (p.Arg249Gln) | ATTCATTCRAATTCATTTTGGGG | Primary familial hypertrophic cardiomyopathy, Familial hypertrophic cardiomyopathy 1, Cardiomyopathy |
| 397516088 | MYH7 | NM_000257.3(MYH7): c.1063G>A (p.Ala355Thr) | ACAGGCRCCATCATGCACTTTGG | Cardiomyopathy, not specified |
| 397516097 | MYH7 | NM_000257.3(MYH7): c.1273G>A (p.Gly425Arg) | TGCCACTRGGGCACTGGCCAAGG | Primary familial hypertrophic cardiomyopathy, Cardiomyopathy |
| 397516101 | MYH7 | NM_000257.3(MYH7): c.1358G>A (p.Arg453His) | CAGCCACRCCAGTACTTCATAGG | Primary familial hypertrophic cardiomyopathy, Familial hypertrophic cardiomyopathy 1, Cardiomyopathy, Hypertrophic cardiomyopathy |
| 397516135 | MYH7 | NM_000257.3(MYH7): c.2168G>A (p.Arg723His) | GTATCRCATCCTGAACCCAGCGG | Familial cardiomyopathy, not specified |
| 397516202 | MYH7 | NM_000257.3(MYH7): c.4135G>A (p.Ala1379Thr) | GGACRCCATTCAGCGGACTGAGG | Primary familial hypertrophic cardiomyopathy, Familial hypertrophic cardiomyopathy 1, Cardiomyopathy |
| 397516241 | MYH7 | NM_000257.3(MYH7): c.5302G>A (p.Glu1768Lys) | AGAGRAGCTGAAGAAGGAGCAGG | Cardiomyopathy, not specified |
| 397516248 | MYH7 | NM_000257.3(MYH7): c.5401G>A (p.Glu1801Lys) | GCCRAGCAGATCGCCCTCAAGGG, AGCCRAGCAGATCGCCCTCAAGG | Myopathy, distal, 1, Familial hypertrophic cardiomyopathy 1, Cardiomyopathy |
| 730880870 | MYH7 | NM_000257.3(MYH7): c.1325G>A (p.Arg442His) | GACGCRCATCAATGCCACCCTGG | Cardiomyopathy |
| 121913628 | MYH7 | NM_000257.3(MYH7): c.2770G>A (p.Glu924Lys) | GAACRAGAGGCTGGAGGATGAGG | Primary familial hypertrophic cardiomyopathy, Familial hypertrophic cardiomyopathy 1, Cardiomyopathy, Hypertrophic cardiomyopathy |
| 121913638 | MYH7 | NM_000257.3(MYH7): c.2146G>A (p.Gly716Arg) | TCTACRGGGACTTCCGGCAGAGG | Primary familial hypertrophic cardiomyopathy, Familial hypertrophic cardiomyopathy 1, Cardiomyopathy, not specified |
| 121913641 | MYH7 | NM_000257.3(MYH7): c.2156G>A (p.Arg719Gln) | TCCRGCAGAGGTGGGTATGAGGG, TTCCRGCAGAGGTGGGTATGAGG | Primary familial hypertrophic cardiomyopathy, Familial hypertrophic cardiomyopathy 1, Cardiomyopathy |
| 121913645 | MYH7 | NM_000257.3(MYH7): c.667G>A (p.Ala223Thr) | CCAGRCCAACCCTGCTCTGGAGG, CATCCAGRCCAACCCTGCTCTGG | Dilated cardiomyopathy 15 |
| 727504274 | MYH7 | NM_000257.3(MYH7): c.3346G>A (p.Glu1116Lys) | ACGCATCRAGGAGCTGGAGGAGG | Primary familial hypertrophic cardiomyopathy, Familial hypertrophic cardiomyopathy 1, Cardiomyopathy |
| 730880156 | MYH7 | NM_000257.3(MYH7): c.532G>A (p.Gly178Arg) | ACAGCRGAGAATCCGGAGCAGGG, CACAGCRGAGAATCCGGAGCAGG | Cardiomyopathy, Left ventricular noncompaction cardiomyopathy |
| 267606909 | MYH7 | NM_000257.3(MYH7): c.5296G>A (p.Ala1766Thr) | GATGRCAGAGGAGCTGAAGAAGG | Left ventricular noncompaction 5 |
| 730880916 | MYH7 | NM_000257.3(MYH7): c.5254G>A (p.Glu1752Lys) | TGCTRAGGAGAAGGCCAAGAAGG | Cardiomyopathy |
| 730880903 | MYH7 | NM_000257.3(MYH7): c.3157C>T (p.Arg1053Trp) | CCTGGAGCGAGCGAAGYGGAAGC | Cardiomyopathy |
| 121913637 | MYH7 | NM_000257.3(MYH7): c.2155C>T (p.Arg719Trp) | CCTCTACGGGACTTCYGGCAGA | Primary familial hypertrophic cardiomyopathy, Familial hypertrophic cardiomyopathy 1, Cardiomyopathy |
| 727503253 | MYH7 | NM_000257.3(MYH7): c.2710C>T (p.Arg904Cys) | CCTGGCAGATGCTGAGGAGYGCT | Dilated cardiomyopathy 15, Cardiomyopathy |
| 727503263 | MYH7 | NM_000257.3(MYH7): c.2011C>T (p.Arg671Cys) | CCCATCCCCACTTTGTAYGTTGT, CCATCCCCACTTTGTAYGTTGTA | Cardiomyopathy, not specified |
| 727504240 | MYH7 | NM_000257.3(MYH7): c.2080C>T (p.Arg694Cys) | CCTGGTCATGCACCAGCTGYGCT | Primary familial hypertrophic cardiomyopathy, Cardiomyopathy |
| 606231324 | MYH7 | NM_000257.3(MYH7): c.1573G>A (p.Glu525Lys) | CCAAAGAGGCACCTTCTYGATGA | Familial cardiomyopathy, Dilated cardiomyopathy 15, Left ventricular noncompaction cardiomyopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730880817 | MYH7 | NM_000257.3(MYH7): c.5399C>T (p.Ala1800Val) | CCGGCTGGACGAAGYCGAGCAGA | Cardiomyopathy |
| 730880918 | MYH7 | NM_000257.3(MYH7): c.5786C>T (p.Thr1929Met) | CCGTGACATTGGCAYGAAGGTGG | Cardiomyopathy, not specified |
| 202141173 | MYH7 | NM_000257.3(MYH7): c.2606G>A (p.Arg869His) | CCTCCAGCTCCTTGCGGYGAGCC, CCAGCTCCTTGCGGYGAGCCTCG | Cardiomyopathy, not specified |
| 80338828 | MYH9 | NM_002473.5(MYH9): c.2114G>A (p.Arg705His) | GCCRCCAGGGCTTCCCCAACAGG | Deafness, autosomal dominant nonsyndromic sensorineural 17, MYH9 related disorders |
| 80338827 | MYH9 | NM_002473.5(MYH9): c.2105G>A (p.Arg702His) | GGCATCCRTATCTGCCGCCAGGG, GGGCATCCRTATCTGCCGCCAGG | Epstein syndrome, Fechtner syndrome, MYH9 related disorders |
| 80338834 | MYH9 | NM_002473.5(MYH9): c.5521G>A (p.Glu1841Lys) | TCGGACCRAGAAGAAGCTGAAGG | May-Hegglin anomaly, Fechtner syndrome, MYH9 related disorders |
| 121913657 | MYH9 | NM_002473.5(MYH9): c.287C>T (p.Ser96Leu) | CCTCAACGAAGCCTYGGTGCTGC | Epstein syndrome, MYH9 related disorders |
| 80338835 | MYH9 | NM_002473.5(MYH9): c.5797C>T (p.Arg1933Ter) | CCGTTTGTCGTGCCCCGCYGAAT | May-Hegglin anomaly, Fechtner syndrome, Sebastian syndrome, MYH9 related disorders |
| 397516406 | MYL2 | NM_000432.3(MYL2): c.485G>A (p.Gly162Glu) | CCACGRAGAAGAGAAGGACTAGG | Familial hypertrophic cardiomyopathy 10, Cardiomyopathy |
| 199474814 | MYL2 | NM_000432.3(MYL2): c.484G>A (p.Gly162Arg) | CCACRGAGAAGAGAAGGACTAGG | Cardiomyopathy, not specified, not provided |
| 727503309 | MYO15A | NM_016239.3(MYO15A): c.5531+1G>A | ATCGACAGRTATCTTGGTTACGG | Deafness, autosomal recessive 3 |
| 201978571 | MYO15A | NM_016239.3(MYO15A): c.6046+1G>A | CAGRTGGGTCAGCACCAGGCGGG, GCAGRTGGGTCAGCACCAGGCGG, GTGGCAGRTGGGTCAGCACCAGG | Deafness, autosomal recessive 3 |
| 727503316 | MYO15A | NM_016239.3(MYO15A): c.7893+1G>A | CCAGRTGAGGGGGGAAGGTGGGG, CCCAGRTGAGGGGGGAAGGTGGG, ACCCAGRTGAGGGGGGAAGGTGG | Deafness, autosomal recessive 3 |
| 121908104 | MYO5B | NM_001080467.2(MYO5B): c.1125G>A (p.Trp375Ter) | CTGRCTGTGTCATCGCAAGCTGG | Congenital microvillous atrophy |
| 121908106 | MYO5B | NM_001080467.2(MYO5B): c.1979C>T (p.Pro660Leu) | CCGCTGCATCAAGCYCAACGATG | Congenital microvillous atrophy |
| 121965082 | MYO7A | NM_000260.3(MYO7A): c.1797G>A (p.Met599Ile) | TCGCCATRGTAAGCCGGGTGCGG | Deafness, autosomal recessive 2, Usher syndrome, type 1B |
| 397516283 | MYO7A | NM_000260.3(MYO7A): c.1200+1G>A | AAAGRTGGGCTGGAGGGAAGGGG, TAAAGRTGGGCTGGAGGGAAGGG, GTAAAGRTGGGCTGGAGGGAAGG | Usher syndrome, type 1 |
| 111033178 | MYO7A | NM_000260.3(MYO7A): c.3719G>A (p.Arg1240Gln) | CACRGACACAGCCGCCCAGCTGG | Usher syndrome, type 1 |
| 387906700 | MYO7A | NM_000260.3(MYO7A): c.1184G>A (p.Arg395His) | CGTGCRCGACGCCTTCGTAAAGG | Deafness, autosomal recessive 2 |
| 121965080 | MYO7A | NM_000260.3(MYO7A): c.634C>T (p.Arg212Cys) | CCGCAATGACAACTCAAGCYGTT | Usher syndrome, type 1B |
| 773844428 | MYO7A | NM_000260.3(MYO7A): c.5968C>T (p.Gln1990Ter) | CCCTCACTCACCTACYAGGTGTT, CCTCACTCACCTACYAGGTGTTC | Usher syndrome, type 1 |
| 397516291 | MYO7A | NM_000260.3(MYO7A): c.1963C>T (p.Gln655Ter) | CCGGCACCTGTGCGTGCGCYAGC | Usher syndrome, type 1 |
| 397516321 | MYO7A | NM_000260.3(MYO7A): c.5617C>T (p.Arg1873Trp) | CCATCGACTGCCTGCAAYGGCTC | Usher syndrome, type 1 |
| 111033180 | MYO7A | NM_000260.3(MYO7A): c.1900C>T (p.Arg634Ter) | CCAGCCCTTCTTTGTGYGATGCA | Usher syndrome, type 1 |
| 111033182 | MYO7A | NM_000260.3(MYO7A): c.5101C>T (p.Arg1701Ter) | CCGGCTCTTGCAGCTGYGAACGG | Usher syndrome, type 1 |
| 199606180 | MYO7A | NM_000260.3(MYO7A): c.5660C>T (p.Pro1887Leu) | CCCGGAAGTACCCTCYGCACCTG, CCGGAAGTACCCTCYGCACCTGG | Usher syndrome, type 1 |
| 74315340 | MYOC | NM_000261.1(MYOC): c.734G>A (p.Cys245Tyr) | AGGATRTGGAGAACTAGTTTGGG, CAGGATRTGGAGAACTAGTTTGG | Primary open angle glaucoma juvenile onset 1 |
| 74315330 | MYOC | NM_000261.1(MYOC): c.1109C>T (p.Pro370Leu) | CCACGGACAGTTCCYGTATTCTT | Primary open angle glaucoma juvenile onset 1 |
| 121908461 | MYOT | NM_006790.2(MYOT): c.116C>T (p.Ser39Phe) | CCAGACCAAACAGTCTTYCATTA | Spheroid body myopathy |
| 71584501 | MYPN | NM_032578.3(MYPN): c.3263G>A (p.Arg1088His) | TGAGGGGCRCCTCTGTCGGCTGG | Dilated cardiomyopathy 1KK, not provided |
| 587777772 | NADK2 | NM_001287341.1(NADK2): c.595C>T (p.Arg199Ter) | TGTCRTTTTGCTGTTGAAAAAGG | 2,4-Dienoyl-CoA reductase deficiency |
| 121434529 | NAGA | NM_000262.2(NAGA): c.973G>A (p.Glu325Lys) | CTCTCATCRAAGTGTACATGCGG | Schindler disease, type 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434533 | NAGA | NM_000262.2(NAGA): c.986G>A (p.Arg329Gln) | CATGCRGCCTCTGTCCAACAAGG | Kanzaki disease |
| 104894590 | NAGLU | NM_000263.3(NAGLU): c.2021G>A (p.Arg674His) | CCCTCRCTGGCGGCTTTTCCTGG | Mucopolysaccharidosis, MPS-III-B, not provided |
| 104894593 | NAGLU | NM_000263.3(NAGLU): c.1928G>A (p.Arg643His) | GCCRCTACCAGCTGACCTTGTGG | Mucopolysaccharidosis, MPS-III-B |
| 398123281 | NAGLU | NM_000263.3(NAGLU): c.503G>A (p.Trp168Ter) | ACTGGCCTRGAGCGGCCAGGAGG | not provided |
| 104894595 | NAGLU | NM_000263.3(NAGLU): c.1562C>T (p.Pro521Leu) | CCCGCTGGTCAGGCGGCYGTCCC, CCGCTGGTCAGGCGGCYGTCCCT | Mucopolysaccharidosis, MPS-III-B |
| 104894596 | NAGLU | NM_000263.3(NAGLU): c.1444C>T (p.Arg482Trp) | CCAGCTTTGCCGCCCGGYGGTAT | Mucopolysaccharidosis, MPS-III-B |
| 104894597 | NAGLU | NM_000263.3(NAGLU): c.1693C>T (p.Arg565Trp) | CCTGCTGGACCTCACTYGGCAGG | Mucopolysaccharidosis, MPS-III-B |
| 104894601 | NAGLU | NM_000263.3(NAGLU): c.700C>T (p.Arg234Cys) | CCGGGTCCTGGACCAGATGYGCT | Mucopolysaccharidosis, MPS-III-B |
| 786203986 | NALCN | NM_052867.2(NALCN): c.1768C>T (p.Leu590Phe) | CCATTTTATAGATCYTCCTGAGT | CONGENITAL CONTRACTURES OF THE LIMBS AND FACE, HYPOTONIA, AND DEVELOPMENTAL DELAY |
| 4987076 | NAT1 | NM_001160179.2(NAT1): c.445G>A (p.Val149Ile) | GCCTTGTRTCTTCCGTTTGACGG | |
| 387907112 | NBEAL2 | NM_015175.2(NBEAL2): c.2701C>T (p.Arg901Ter) | CCTGCTGCCCCTGCTGGAGYGAG | Gray platelet syndrome |
| 786204181 | NBN | NM_002485.4(NBN): c.2165G>A (p.Trp722Ter) | AGAGTRGCTAAGGCAGGAAATGG | Microcephaly, normal intelligence and immunodeficiency |
| 767215758 | NBN | NM_002485.4(NBN): c.1030C>T (p.Gln344Ter) | CCTTRTGAAAGGCTTGGTCCTGG | Microcephaly, normal intelligence and immunodeficiency |
| 119103271 | NCF1 | NM_000265.5(NCF1): c.271C>T (p.Gln91Ter) | CCGCCGAGAACCGCYAGGGCACA | Chronic granulomatous disease, autosomal recessive cytochrome b-positive, type 1 |
| 374402066 | NCF2 | NM_000433.3(NCF2): c.304C>T (p.Arg102Ter) | GTTCCCTCRAAGCTGAATCAAGG | Chronic granulomatous disease, autosomal recessive cytochrome b-positive, type 2 |
| 796065032 | NCF2 | NM_000433.3(NCF2): c.366+1G>A | GAGRTAAGGAGAACAGGGCCTGG, CCTGTGAGRTAAGGAGAACAGGG | Chronic granulomatous disease, autosomal recessive cytochrome b-positive, type 2 |
| 398123577 | NDE1 | NM_001143979.1(NDE1): c.704-1G>A | CCARGCCTGGACGACTCCACCGG | not provided |
| 104894883 | NDP | NM_000266.3(NDP): c.302C>T (p.Ser101Phe) | CCGGCCCCAGACTTYCAAGCTGA | Atrophia bulborum hereditaria |
| 28933684 | NDP | NM_000266.3(NDP): c.370C>T (p.Leu124Phe) | CCACCTACCGGTACATCYTCTCC, CCACCTACCGGTACATCYTCTGT | Familial exudative vitreoretinopathy, X-linked |
| 119483085 | NDRG1 | NM_001135242.1(NDRG1): c.442C>T (p.Arg148Ter) | CCTACATCCTAACTYGATTTGCT | Charcot-Marie-Tooth disease, type 4D |
| 606231459 | NDST1 | NM_001543.4(NDST1):1 c.1831G>A (p.Gly611Ser) | ATCATCRGCCCCCAGAAAACAGG | Mental retardation, autosomal recessive 46 |
| 199422225 | NDUFS1 | NM_005006.6(NDUFS1): c.721C>T (p.Arg241Trp) | CCCTATGCCTTTACTGCCYGGCC, CCTATGCCTTTACTGCCYGGCCT | Mitochondrial complex I deficiency |
| 104893899 | NDUFS4 | NM_002495.2(NDUFS4): c.44G>A (p.Trp15Ter) | GTTGTRGCGGAGAAGGGCAGTGG | Mitochondrial complex I deficiency |
| 121434479 | NDUFS7 | NM_024407.4(NDUFS7): c.434G>A (p.Arg145His) | CGCRCTACGTGGTCTCCATGGGG, CCGCRCTACGTGGTCTCCATGGG, GCCGCRCTACGTGGTCTCCATGG | Leigh syndrome due to mitochondrial complex I deficiency |
| 121912638 | NDUFS8 | NM_002496.3(NDUFS8): c.305G>A (p.Arg102His) | GCTGCRCCGGTACCCATCCGGG, CGCTGCRCCGGTACCCATCCGGG, GCGCTGCRCCGGTACCCATCCGG | Mitochondrial complex I deficiency |
| 28939679 | NDUFS8 | NM_002496.3(NDUFS8): c.236C>T (p.Pro79Leu) | CCTGTTCCGGGAACYGGCCACCA | Mitochondrial complex I deficiency |
| 121912639 | NDUFS8 | NM_002496.3(NDUFS8): c.254C>T (p.Pro85Leu) | CCGGCCACCATCAACTACCYGTT, CCACCATCAACTACCYGTTCGAG | Mitochondrial complex I deficiency |
| 59101996 | NEFL | NM_006158.4(NEFL): c.446C>T (p.Ala149Val) | CCGCGACCTGCGCCTGGYGGCGG | Charcot-Marie-Tooth disease, type 1F, not provided |
| 104893983 | NEU1 | NM_000434.3(NEU1): c.727G>A (p.Gly243Arg) | CGCTACRGAAGTGGGGTCAGCGG | Sialidosis type I, not provided |
| 104893986 | NEU1 | NM_000434.3(NEU1): c.69G>A (p.Trp23Ter) | CTGRGGAGGCTGTAGGGTTTGGG, TCTGRGGAGGCTGTAGGGTTTGG | Sialidosis, type II |
| 28940583 | NEU1 | NM_000434.3(NEU1): c.649G>A (p.Val217Met) | GCCTCATCRTGTGTGGCCATGGG | Sialidosis type I |
| 104893981 | NEU1 | NM_000434.3(NEU1): c.893C>T (p.Ala298Val) | CCTCCGCAGCTATGATGYCTGTG, CCGCAGCTATGATGYCTGTGATA | Sialidosis, type II |
| 104893979 | NEU1 | NM_000434.3(NEU1): c.946C>T (p.Pro316Ser) | CCCTGAGCTCGTGGACYCTGTGG, CCTGAGCTCGTGGACYCTGTGGT | Sialidosis type I |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 786203443 | NF1 | NM_001042492.2(NF1): c.8095C>T (p.Gln2699Ter) | CCCCACCACAATACYAAACATCT | Hereditary cancer-predisposing syndrome |
| 786203448 | NF1 | NM_001042492.2(NF1): c.625C>T (p.Gln209Ter) | CCCTAAAGAAGGTTGCGYAGTTA, CCTAAAGAAGGTTGCGYAGTTAG | Hereditary cancer-predisposing syndrome |
| 768638173 | NF1 | NM_000267.3(NF1): c.2041C>T (p.Arg681Ter) | CCCCCCCGATTTGCYGACAAGCC | Neurofibromatosis, type 1 |
| 137854559 | NF1 | NM_000267.3(NF1): c.4021C>T (p.Gln1341Ter) | CCAGCGGAACCTCCTTYAGATGA | Neurofibromatosis, type 1 |
| 121434259 | NF2 | NM_000268.3(NF2): c.169C>T (p.Arg57Ter) | CCGGACTCTGGGGCTCYGAGAAA | Meningioma |
| 74315501 | NF2 | NM_000268.3(NF2): c.1219C>T (p.Gln407Ter) | CCGCAGAGGCTGAGYAGGAAATG | Neurofibromatosis, type 2 |
| 74315496 | NF2 | NM_000268.3(NF2): c.784C>T (p.Arg262Ter) | CCCGTGGAATGAAATCYGAAACA, CCGTGGAATGAAATCYGAAACAT | Neurofibromatosis, type 2 |
| 387907253 | NFIX | NM_002501.3(NFIX): c.568C>T (p.Gln190Ter) | CCTGCAGAATCCGGAYAATCAGA | Sotos syndrome 2 |
| 118204453 | NHEJ1 | NM_024782.2(NHEJ1): c.532C>T (p.Arg178Ter) | CCTTCTTATTACAGATYGATTGA | Severe combined immunodeficiency with microcephaly, growth retardation, and sensitivity to ionizing radiation |
| 104894881 | NHS | NM_198270.3(NHS): c.115C>T (p.Gln39Ter) | CCGCCGCCGCCCTTGYAGCCGCC | Nance-Horan syndrome |
| 587784027 | NIPBL | NM_133433.3(NIPBL): c.6954+1G>A | GTTCAGRTAAGCATGTTTTATGG | Cornelia de Lange syndrome 1 |
| 80358367 | NIPBL | NM_015384.4(NIPBL): c.133C>T (p.Arg45Ter) | CCTTCTCTTTAATGCAYGAATAG | Cornelia de Lange syndrome 1 |
| 587783901 | NIPBL | NM_133433.3(NIPBL): c.2389C>T (p.Arg797Ter) | CCTCGGTTAAAATCAGAAYGAGC | Cornelia de Lange syndrome 1 |
| 587784062 | NIPBL | NM_133433.3(NIPBL): c.892C>T (p.Gln298Ter) | CCACCTTTAATCCTAYAATCTCA | Cornelia de Lange syndrome 1 |
| 587784065 | NIPBL | NM_133433.3(NIPBL): c.922C>T (p.Arg308Ter) | CCTTGTTCATCACCTYGAGATGT | Cornelia de Lange syndrome 1 |
| 137852694 | NKX2-1 | NM_001079668.2(NKX2-1): c.745C>T (p.Gln249Ter) | CCGCTACAAAATGAAGCGCYAGG | Benign hereditary chorea |
| 28936670 | NKX2-5 | NM_004387.3(NKX2-5): c.73C>T (p.Arg25Cys) | CCTGGAACAGCAGCAGYGCAGCC | Tetralogy of Fallot, Congenital heart disease, Interrupted aortic arch, Hypothyroidism, congenital, nongoitrous, 5, Hypoplastic left heart syndrome 2, Truncus arteriosus, not specified, Malformation of the heart and great vessels, not provided |
| 104893900 | NKX2-5 | NM_004387.3(NKX2-5): c.533C>T (p.Thr178Met) | CCAGCGTGCTGAAACTCAYGTCC | Atrial septal defect 7 with or without atrioventricular conduction defects |
| 104893901 | NKX2-5 | NM_004387.3(NKX2-5): c.508C>T (p.Gln170Ter) | CCCCCGAACGCGACYAGCTGGCC | Atrial septal defect 7 with or without atrioventricular conduction defects |
| 104893902 | NKX2-5 | NM_004387.3(NKX2-5): c.656C>T (p.Ala219Val) | CCGCCTGCCCGCAGGATCGYGGT, CCTGCCCGCAGGATCGYGGTGCC | Tetralogy of Fallot |
| 104893905 | NKX2-5 | NM_004387.3(NKX2-5): c.646C>T (p.Arg216Cys) | CCGCCGCCGCCGCCTGCCYGCAG, CCGCCGCCGCCTGCCYGCAGGAT | Tetralogy of Fallot |
| 104895564 | NLRP12 | NM_144687.3(NLRP12): c.850C>T (p.Arg284Ter) | CCTCTCCAGGAGCTCATCYGAGT | Familial cold autoinflammatory syndrome 2, not provided |
| 121908146 | NLRP3 | NM_001243133.1(NLRP3): c.1316C>T (p.Ala439Val) | CCAAGACCACCACCGYGGTGTAC | Familial cold urticaria |
| 121908149 | NLRP3 | NM_001243133.1(NLRP3): c.1055C>T (p.Ala352Val) | CCACGAGACCTGTGGYCCTGGAG | Familial amyloid nephropathy with urticaria AND deafness, Familial cold urticaria |
| 150726175 | NMNAT1 | NM_022787.3(NMNAT1): c.769G>A (p.Glu257Lys) | ACAGCTCTRAGAGTGAAGACAGG | Leber congenital amaurosis 9 |
| 387907294 | NMNAT1 | NM_022787.3(NMNAT1): c.25G>A (p.Val9Met) | GAARTGGTTCTCCTTGCTTGTGG | Leber congenital amaurosis 9 |
| 193303102 | NOBOX | NM_001080413.3(NOBOX): c.907C>T (p.Arg303Ter) | CCTGACAGTGATAAACGCYGAGA | Premature ovarian failure 5 |
| 104895461 | NOD2 | NM_022162.2(NOD2): c.1001G>A (p.Arg334Gln) | CTGCCRGCAGCTGCAGTGCATGG | Sarcoidosis, early-onset, Blau syndrome |
| 104895460 | NOD2 | NM_022162.2(NOD2): c.1405C>T (p.Leu469Phe) | CCCGGGGTGGCGGACCGCYTCAT, CCGGGGTGGCGGACCGCYTCATC | Sarcoidosis, early-onset, Blau syndrome |
| 121909283 | NODAL | NM_018055.4(NODAL): c.778G>A (p.Gly260Arg) | ACCTGATCRGATGGGGCTCCTGG | Visceral heterotaxy 5, autosomal |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894612 | NOG | NM_005450.4(NOG): c.551G>A (p.Cys184Tyr) | CGCTCGTRCTCCGTGCCCGAGGG, GCGCTCGTRCTCCGTGCCCGAGG | Cushing symphalangism |
| 587777734 | NOTCH1 | NM_017617.3(NOTCH1): c.5965G>A (p.Asp1989Asn) | CCATCATGCATGCGGGCATYCAG | Adams-Oliver syndrome 5 |
| 312262797 | NOTCH2 | NM_024408.3(NOTCH2): c.5858G>A (p.Arg1953His) | GCTGCCCRCCTGGCTGTGGAGGG, GGCTGCCCRCCTGGCTGTGGAGG | Alagille syndrome 2 |
| 111033632 | NOTCH2 | NM_024408.3(NOTCH2): c.1331G>A (p.Cys444Tyr) | GAGTRTCTGAAGGGTTATGCAGG | Alagille syndrome 2 |
| 312262796 | NOTCH2 | NM_024408.3(NOTCH2): c.5857C>T (p.Arg1953Cys) | CCCCTGATCCTGGCTGCCYGCCT, CCCTGATCCTGGCTGCCYGCCTG, CCTGATCCTGGCTGCCYGCCTGG | Alagille syndrome 2 |
| 387906747 | NOTCH2 | NM_024408.3(NOTCH2): c.6949C>T (p.Gln2317Ter) | CCCTAAAGGCAGTATTGCCYAAC, CCTAAAGGCAGTATTGCCYAACC | Hajdu-Cheney syndrome |
| 387906749 | NOTCH2 | NM_024408.3(NOTCH2): c.7165C>T (p.Gln2389Ter) | CCCCACACCCCTTCAYAGCACA, CCCCACACCCCTTCAYAGCACAG, CCACACCCCTTCAYAGCACAGT | Hajdu-Cheney syndrome |
| 28933696 | NOTCH3 | NM_000435.2(NOTCH3): c.505C>T (p.Arg169Cys) | CCGGGTGGGTGAGCCCTGCYGCC | Cerebral autosomal dominant arteriopathy with subcortical infarcts and leukoencephalopathy |
| 137852641 | NOTCH3 | NM_000435.2(NOTCH3): c.994C>T (p.Arg332Cys) | CCACCTGCCATGACYGCGTGGCT | Cerebral autosomal dominant arteriopathy with subcortical infarcts and leukoencephalopathy |
| 120074130 | NPC1 | NM_000271.4(NPC1): c.2665G>A (p.Val889Met) | GCCRTGTACTTTGTCCTGGAGG, TCCGCCRTGTACTTTGTCCTGG | NIEMANN-PICK DISEASE, TYPE C1, ADULT FORM |
| 483352891 | NPC1 | NM_000271.4(NPC1): c.2366G>A (p.Arg789His) | TTAAACRTCAAGAGGTAAGTTGG | Niemann-Pick disease type C1 |
| 104894458 | NPC2 | NM_006432.3(NPC2): c.358C>T (p.Pro120Ser) | CCAGTGAAAAGCGAATATYCCTC | Niemann-Pick disease type C2 |
| 140130028 | NPC2 | NM_006432.3(NPC2): c.441+1G>A | CCCCCAGATAGACTTAYGATCTG, CCCCAGATAGACTTAYGATCTGT, CCCAGATAGACTTAYGATCTGTA | Niemann-Pick disease type C2, not provided |
| 137852920 | NPHP4 | NM_015102.4(NPHP4): c.2044C>T (p.Arg682Ter) | CCCACCCGCAACGACGCCAYGAC, CCACCCGCAACGACGCCAYGACT, CCCGCAACGACGCCAYGACTGCA, CCGCAACGACGCCAYGACTGCAG | Nephronophthisis 4, Infertility, Cerebello-oculo-renal syndrome (nephronophthisis, oculomotor apraxia and cerebellar abnormalities) |
| 137852922 | NPHP4 | NM_015102.4(NPHP4): c.2335C>T (p.Gln779Ter) | CCAAGGCCGGCCGGCTGTGYAGG | Senior-Loken syndrome 4 |
| 28939695 | NPHS1 | NM_004646.3(NPHS1): c.1339G>A (p.Glu447Lys) | TGGATTRAGGGTCCCCCAGAGGG, GTGGATTRAGGGTCCCCCAGAGG | Proteinuria, Finnish congenital nephrotic syndrome, not specified |
| 758478717 | NPR2 | NM_003995.3(NPR2): c.328C>T (p.Arg110Cys) | CCCTGCTGCCTCTGTGGCCYGCT, CCTGCTGCCTCTGTGGCCYGCTT | SHORT STATURE WITH NONSPECIFIC SKELETAL ABNORMALITIES |
| 104894889 | NROB1 | NM_000475.4(NROB1): c.704G>A (p.Trp235Ter) | CCCTRGTGGGACACCTCCTCTGG | Congenital adrenal hypoplasia, X-linked |
| 104894894 | NROB1 | 183CNM_000475.4(NROB1): c.1>T (p.Gln395Ter) | CCAGACGTGCCGGGCCTGYAGTG | Congenital adrenal hypoplasia, X-linked |
| 28937873 | NR2E3 | NM_014249.3(NR2E3): c.932G>A (p.Arg311Gln) | TCGGTTCCRGGCATTGGCGGTGG | Goldmann-Favre syndrome, Enhanced s-cone syndrome, not provided |
| 104894493 | NR2E3 | NM_014249.3(NR2E3): c.227G>A (p.Arg76Gln) | TACRGCGGAGGCTCATCTACAGG | Enhanced s-cone syndrome |
| 6189 | NR3C1 | NM_000176.2(NR3C1): c.66G>A (p.Glu22=) | TCAGGARAGGGGAGATGTGATGG | |
| 121912566 | NR3C2 | NM_000901.4(NR3C2): c.1897G>A (p.Gly633Arg) | TGGAARGTAAATGTTCATGTGGG, GTGGAARGTAAATGTTCATGTGG | Pseudohypoaldosteronism type 1 autosomal dominant |
| 121912573 | NR3C2 | NM_000901.4(NR3C2): c.2453C>T (p.Ser818Leu) | CCTTGAGCTGGAGATYGTACAAA | Pseudohypoaldosteronism type 1 autosomal dominant |
| 104894124 | NR5A1 | NM_004959.4(NR5A1): c.43G>A (p.Val15Met) | GTGCCCRTGTGCGGGACAAGG | 46,XY sex reversal, type 3 |
| 104894126 | NR5A1 | NM_004959.4(NR5A1): c.271G>A (p.Gly91Ser) | GGGGTRGCCGGAACAAGTTTGGG, AGGGGTRGCCGGAACAAGTTTGG | 46,XY sex reversal, type 3 |
| 200749741 | NR5A1 | NM_004959.4(NR5A1): c.386C>T (p.Pro129Leu) | GGCGGGRGCACCCCCATCGGGGG, CGGCGGGRGCACCCCCATCGGGG, GCGGCGGGRGCACCCCCATCGGG | Premature ovarian failure 7, Spermatogenic failure 8 |
| 121918656 | NR5A1 | NM_004959.4(NR5A1): c.3G>A (p.MetIle) | CATRGACTATTCGTACGACGAGG | 46,XY sex reversal, type 3, Premature ovarian failure 7 |
| 387906690 | NR5A1 | NM_004959.4(NR5A1): c.392C>T (p.Pro131Leu) | CCGATGGGGTGCCCCCGCYGCC | Spermatogenic failure 8 |
| 587784131 | NSD1 | NM_022455.4(NSD1): c.4966+1G>A | AAAGRTATGGATTTCTTATGTGG | Sotos syndrome 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587784149 | NSD1 | NM_022455.4(NSD1): c.5432G>A (p.Arg1811Gln) | GGCCCRAGTCTTCCCTTACATGG | Sotos syndrome 1 |
| 587784071 | NSD1 | NM_022455.4(NSD1): c.1262G>A (p.Trp421Ter) | AGTAAATRGGAAGCCAGTGTTGG | Sotos syndrome 1 |
| 587784174 | NSD1 | NM_022455.4(NSD1): c.6014G>A (p.Arg2005Gln) | TAGGACCRAATCATTGATGCTGG | Sotos syndrome 1 |
| 587784137 | NSD1 | NM_022455.4(NSD1): c.5098C>T (p.Arg1700Ter) | CCCCTAGGCGGGGCTGCYGAAAT, CCCTAGGCGGGGCTGCYGAAATC, CCTAGGCGGGGCTGCYGAAATCA | Sotos syndrome 1 |
| 587784107 | NSD1 | NM_022455.4(NSD1): c.3964C>T (p.Arg1322Ter) | CCTTCTAGCCCGAGGTYGATCTA | Sotos syndrome 1 |
| 587784117 | NSD1 | NM_022455.4(NSD1): c.4417C>T (p.Arg1473Ter) | CCAAGGAAGCGAAAAYGACAGAG | Sotos syndrome 1 |
| 587784151 | NSD1 | NM_022455.4(NSD1): c.5566C>T (p.Gln1856Ter) | CCCAAAAAGAGCTAAGAYAGCTG, CCAAAAAGAGCTAAGAYAGCTGC | Sotos syndrome 1 |
| 587784176 | NSD1 | NM_022455.4(NSD1): c.6049C>T (p.Arg2017Trp) | CCCAAAGGAAACTATGCTYGGTT, CCAAAGGAAACTATGCTYGGTTC | Sotos syndrome 1 |
| 587784209 | NSD1 | NM_022455.4(NSD1): c.6559C>T (p.Arg2187Ter) | CCTTTTGTAAGCAGCATYGAGAA | Sotos syndrome 1 |
| 587784096 | NSD1 | NM_022455.4(NSD1): c.3091C>T (p.Arg1031Ter) | CCTTCATCCAAATTGYGAGATGC | Sotos syndrome 1 |
| 587776908 | NSUN2 | NM_017755.5(NSUN2): c.2035G>A (p.Gly679Arg) | CCTTTCCCCGCCATCYGCATAAG | Mental retardation, autosomal recessive 5 |
| 587777173 | NT5C2 | NM_012229.4(NT5C2): c.85C>T (p.Arg29Ter) | TTCTCRACGATACTTTTTCAGGG, CTTCTCRACGATACTTTTTCAGG | |
| 150766139 | NTHL1 | NM_002528.5(NTHL1): c.268C>T (p.Gln90Ter) | CAGTCCTRGGGCTCCCAGACTGG | FAMILIAL ADENOMATOUS POLYPOSIS 3 |
| 606231467 | NTRK1 | NM_002529.3(NTRK1): c.1550G>A (p.Gly517Glu) | AGCTGGRGGAGGGCGCCTTTGGG, GAGCTGGRGGAGGGCGCCTTTGG | Hereditary insensitivity to pain with anhidrosis |
| 121964868 | NTRK1 | NM_001007792.1(NTRK1): c.1976C>T (p.Pro659Leu) | CCCATTCGCTGGATGCYGCCCGA, CCATTCGCTGGATGCYGCCCGAG | Hereditary insensitivity to pain with anhidrosis |
| 62637037 | NYX | NM_022567.2(NYX): c.1049G>A (p.Trp350Ter) | AGGGACTRGATGGAGGGCTCCGG | Congenital stationary night blindness, type 1A, not provided |
| 121965042 | OAT | NM_000274.3(OAT): c.812G>A (p.Arg271Lys) | GGCCARAACTGGTAGATGGCTGG | Ornithine aminotransferase deficiency |
| 121965049 | OAT | NM_000274.3(OAT): c.955C>T (p.His319Tyr) | CCATTAAGCCAGGGGAGYATGAG | Ornithine aminotransferase deficiency |
| 121918216 | OBSL1 | NM_015311.2(OBSL1): c.1465C>T (p.Arg489Ter) | CCTTCCAGGGGTCACCYGAGAGG | Three M syndrome 2 |
| 74653330 | OCA2 | NM_000275.2(OCA2): c.1441G>A (p.Ala481Thr) | AGGAGCTRCCACTGCCATCGGGG, GAGGAGCTRCCACTGCCATCGGG | Tyrosinase-positive oculocutaneous albinism |
| 121918167 | OCA2 | NM_000275.2(OCA2): c.2228C>T (p.Pro743Leu) | CCCTGATTGACAACATCCYGTTC, CCTGATTGACAACATCCYGTTCA | Tyrosinase-positive oculocutaneous albinism |
| 121918168 | OCA2 | NM_000275.2(OCA2): c.1001C>T (p.Ala334Val) | CCCAGGTGACCATCGYGACGGCC, CCAGGTGACCATCGYGACGGCCA | Tyrosinase-positive oculocutaneous albinism |
| 137853260 | OCRL | NM_000276.3(OCRL): c.1499G>A (p.Arg500Gln) | TGTGACCRAATTCTTTGGAGAGG | Lowe syndrome |
| 312262864 | OFD1 | NM_003611.2(OFD1): c.1100G>A (p.Arg367Gln) | ATCRACTGATTGAAGATGAAAGG | Oral-facial-digital syndrome |
| 312262812 | OFD1 | NM_003611.2(OFD1): c.221C>T (p.Ser74Phe) | CCCTCTTAATAGGCGCCTYTAAC, CCTCTTAATAGGCGCCTYTAACT | Oral-facial-digital syndrome |
| 312262880 | OFD1 | NM_003611.2(OFD1): c.1420C>T (p.Gln474Ter) | CCTTCTTAGGCCTAGCTYAGCCG | Oral-facial-digital syndrome |
| 28939082 | OPA1 | NM_015560.2(OPA1): c.899G>A (p.Gly300Glu) | TGCTGRAAAGACTAGTGTGTTGG | Dominant hereditary optic atrophy |
| 794727405 | OPA1 | NM_015560.2(OPA1): c.2569C>T (p.Arg857Ter) | CCATTGTAACCTTTGTYGAAGAG | Dominant hereditary optic atrophy, not provided |
| 185836803 | OPLAH | NM_017570.4(OPLAH): c.3265G>A (p.Val1089Ile) | CCAAAGGCCCCAGGATGAYATC | 5-OXoprolinase deficiency |
| 104894913 | OPN1LW | NM_020061.5(OPN1LW): c.1013G>A (p.Gly338Glu) | TTCRGAAGAAGGTTGACGATGG | Protan defect |
| 104894912 | OPN1LW | NM_020061.5(OPN1LW): c.739C>T (p.Arg247Ter) | CCAAGTGTGGCTGGCCATCYGAG | Cone monochromatism |
| 28939688 | OPTN | NM_001008211.1(OPTN): c.148G>A (p.Glu50Lys) | ACCRAGAACCACCAGCTGAAAGG | Glaucoma 1, open angle, e |
| 587777528 | ORAI1 | NM_032790.3(ORAI1): c.734C>T (p.Pro245Leu) | CCACCATCATGGTGCYCTTCGGC | Myopathy, tubular aggregate, 2 |
| 143141689 | ORC1 | NM_004153.3(ORC1): c.314G>A (p.Arg105Gln) | CCTGTGCACCAGGCTTCYGGCCC | Meier-Gorlin syndrome 1 |
| 72554349 | OTC | NM_000531.5(OTC): c.299G>A (p.Gly100Asp) | GTAGRCTTTGCACTTCTGGGAGG, ATTGTAGRCTTTGCACTTCTGGG, TATTGTAGRCTTTGCACTTCTGG | not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72552296 | OTC | NM_000531.5(OTC): c.3G>A (p.Met1Ile) | AGAAGATRCTGTTTAATCTGAGG | not provided |
| 72552302 | OTC | NM_000531.5(OTC): c.77+5G>A | TAARTGATGGTCAGAGACTTGGG, GTAARTGATGGTCAGAGACTTGG | not provided |
| 72558414 | OTC | NM_000531.5(OTC): c.620G>A (p.Ser207Asn) | ATGATGARCGCAGCGAAATTCGG | not provided |
| 72558442 | OTC | NM_000531.5(OTC): c.787G>A (p.Asp263Asn) | ACARACACTTGGATAAGCATGGG, TACARACACTTGGATAAGCATGG | not provided |
| 72554310 | OTC | NM_000531.5(OTC): c.131C>T (p.Thr44Ile) | CCGTGACCTTCTCAYTCTAAAAA | not provided |
| 72556254 | OTC | NM_000531.5(OTC): c.395C>T (p.Ser132Phe) | CCACAGTGTATTGTYTAGCATGG | not provided |
| 72556284 | OTC | NM_000531.5(OTC): c.533C>T (p.Thr178Met) | CCTGGCTGATTACCTCAYGCTCC | not provided |
| 72558426 | OTC | NM_000531.5(OTC): c.659C>T (p.Pro220Leu) | CCTTCAGGCAGCTACTCYAAAGG | not provided |
| 200656442 | OTOA | NM_144672.3(OTOA): c.1352G>A (p.Gly451Asp) | GATGGRCGCACTGCTGGCTGGGG, AGATGGRCGCACTGCTGGCTGGG, CAGATGGRCGCACTGCTGGCTGG | Deafness, autosomal recessive 22 |
| 587777133 | OTOA | NM_144672.3(OTOA): c.1879C>T (p.Pro627Ser) | CCTCTTGGCTGCACTCYCGTAAG | Deafness, autosomal recessive 22 |
| 397515589 | OTOF | NM_194248.2(OTOF): c.1841G>A (p.Gly614Glu) | TCTCTTTGRAGCCTTCCTGGAGG | Deafness, autosomal recessive 9 |
| 80356592 | OTOF | NM_194248.2(OTOF): c.2381G>A (p.Arg794His) | AGCRCCTCAAGTCCTGCATGAGG | Deafness, autosomal recessive 9, not specified |
| 80356594 | OTOF | NM_194248.2(OTOF): c.2991+1G>A | GAGRTGAGGGCCTGGGAGGAGGG, AGAGRTGAGGGCCTGGGAGGAGG, CACAGAGRTGAGGGCCTGGGAGG | Deafness, autosomal recessive 9 |
| 368790049 | OTOF | NM_194248.2(OTOF): c.5815C>T (p.Arg1939Trp) | CGGGCCRGCTGGAGTATGAAGGG | Deafness, autosomal recessive 9 |
| 199848801 | OTOF | NM_194248.2(OTOF): c.3400C>T (p.Arg1134Ter) | TCGGGCCRGCTGGAGTATGAAGG, ACTCRGTACTTGCTGAGCACGGG, CACTCRGTACTTGCTGAGCACGG | Deafness, autosomal recessive 9 |
| 727504936 | OTOF | NM_194248.2(OTOF): c.2818C>T (p.Gln940Ter) | CCAGGAGGTCAAGGCAGCCYAGG | Deafness, autosomal recessive 9 |
| 397514607 | OTOG | NM_001277269.1(OTOG): c.6347C>T (p.Pro2116Leu) | CCGGTGCTCAATCTTCCYTGACC | Deafness, autosomal recessive 18b |
| 786205224 | OTX2 | NM_172337.2(OTX2): c.235G>A (p.Glu79Lys) | CCCRAGTCGAGGGTGCAGGTAGG, CTTGCCCRAGTCGAGGGTGCAGG | Microphthalmia syndromic 5 |
| 121909301 | OXCT1 | NM_000436.3(OXCT1): c.971G>A (p.Gly324Glu) | GGGCATAGRAATCCCTCTCCTGG | Succinyl-CoA acetoacetate transferase deficiency |
| 121909302 | OXCT1 | NM_000436.3(OXCT1): c.656G>A (p.Gly219Glu) | GAGCAGRAAACGTGATTTTCAGG | Succinyl-CoA acetoacetate transferase deficiency |
| 75134564 | OXCT1 | NM_000436.3(OXCT1): c.173C>T (p.Thr58Met) | CCAAAACCRTGGCACCATCAGGG | Succinyl-CoA acetoacetate transferase deficiency |
| 137853890 | P3H1 | NM_001146289.1(P3H1): c.2073G>A (p.Ala691=) | CTCGAGCRGGTGAGAGCAGCTGG | Osteogenesis imperfecta type 8 |
| 118203996 | P3H1 | NM_001146289.1(P3H1): c.1102C>T (p.Arg368Ter) | CCAAGGAGTACCGACAGYGAAGC | Osteogenesis imperfecta type 8 |
| 587784266 | PAFAH1B1 | NM_000430.3(PAFAH1B1): c.405G>A (p.Trp135Ter) | CAGGTGTGRGATTATGAGACTGG | Lissencephaly 1 |
| 587784258 | PAFAH1B1 | NM_000430.3(PAFAH1B1): c.265C>T (p.Arg89Ter) | CCTCTTGGTCAGAAAYGAGACCC | Lissencephaly 1 |
| 74503222 | PAH | NM_000277.1(PAH): c.745C>T (p.Leu249Phe) | AAARCAGGCCAGCCACAGGTCGG, GAGGAAARCAGGCCAGCCACAGG | Phenylketonuria, not provided |
| 62644499 | PAH | NM_000277.1(PAH): c.1243G>A (p.Asp415Asn) | GCTACRACCCATACACCCAAAGG | Hyperphenylalaninemia, non-pku, not provided |
| 62644503 | PAH | NM_000277.1(PAH): c.755G>A (p.Arg252Gln) | TCCTCTCRGGATTTCTTGGGTGG | Phenylketonuria, not provided |
| 62514893 | PAH | NM_000277.1(PAH): c.3G>A (p.Met1Ile) | CAGCATRTCCACTGCGGTCCTGG | Phenylketonuria, not provided |
| 62514959 | PAH | NM_000277.1(PAH): c.977G>A (p.Trp326Ter) | ACTRGTTTACTGTGGAGTTTGGG, TACTRGTTTACTGTGGAGTTTGG | Phenylketonuria, not provided |
| 62516147 | PAH | NM_000277.1(PAH): c.1065+1G>A | ATTACAGRTATGACCTTCACAGG | not provided |
| 62642937 | PAH | NM_000277.1(PAH): c.1139C>T (p.Thr380Met) | CCAAAATTACACTGTCAYGGAGT | Phenylketonuria, Hyperphenylalaninemia, non-pku, not provided |
| 76687508 | PAH | NM_000277.1(PAH): c.721C>T (p.Arg241Cys) | CCCAGCTTGCACTGGTTTCYGCC, CCAGCTTGCACTGGTTTCYGCCT | Phenylketonuria, not provided |
| 5030851 | PAH | NM_000277.1(PAH): c.842C>T (p.Pro281Leu) | CCCATGTATACCCCCGAACYGTG, CCATGTATACCCCCGAACYGTGA | Phenylketonuria, not provided |
| 121434611 | PAK3 | NM_002578.3(PAK3): c.1255C>T (p.Arg419Ter) | CCTGAGCAAAGTAAAYGAAGCAC | Mental retardation 30, X-linked |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776405 | PALB2 | NM_024675.3(PALB2): c.48G>A (p.Lys16=) | GGAAAARGTGCCGGGGGTGCGGG, AGGAAAARGTGCCGGGGGTGCGG | not provided |
| 180177122 | PALB2 | NM_024675.3(PALB2): c.2718G>A (p.Trp906Ter) | AGTGRGAAAAACTTTATACCTGG | Familial cancer of breast |
| 180177132 | PALB2 | NM_024675.3(PALB2): c.3113G>A (p.Trp1038Ter) | ATTTRGTAAGCTTTCCCTCTAGG | Familial cancer of breast, Hereditary cancer-predisposing syndrome, Breast cancer, susceptibility to |
| 587782050 | PALB2 | NM_024675.3(PALB2): c.3476G>A (p.Trp1159Ter) | AACATTRGTCTTTTGTGAAATGG | Hereditary cancer-predisposing syndrome |
| 118203999 | PALB2 | NM_024675.3(PALB2): c.2962C>T (p.Gln988Ter) | CCCTTTCTGATCAAYAAGTAGAA | Fanconi anemia, complementation group N, Hereditary cancer-predisposing syndrome, Breast cancer, susceptibility to |
| 587776415 | PALB2 | NM_024675.3(PALB2): c.2074C>T (p.Gln692Ter) | CCAAACTCGCAAAGCYAGCATAC | not provided |
| 180177097 | PALB2 | NM_024675.3(PALB2): c.1027C>T (p.Gln343Ter) | CCAGCAAATGAAAACYAAAACTT | Familial cancer of breast, Pancreatic cancer 3, Breast cancer, susceptibility to |
| 180177111 | PALB2 | NM_024675.3(PALB2): c.2323C>T (p.Gln775Ter) | CCAGTGATACTAAAYAATTCGAC | Familial cancer of breast, Hereditary cancer-predisposing syndrome, Breast cancer, susceptibility to |
| 137852966 | PANK2 | NM_153638.2(PANK2): c.832C>T (p.Arg278Cys) | CCTGACTCTGTGTGGAYGCAAAG | |
| 137853056 | PARK2 | NM_004562.2(PARK2): c.1358G>A (p.Trp453Ter) | AGTRGAACCGCGTCTGCATGGGG, GAGTRGAACCGCGTCTGCATGGG, CGAGTRGAACCGCGTCTGCATGG | Parkinson disease 2 |
| 79555199 | PAX2 | NM_003990.3(PAX2): c.226G>A (p.Gly76Ser) | GAGACCRGCAGCATCAAGCCGGG, CGAGACCRGCAGCATCAAGCCGG | Renal coloboma syndrome |
| 104893651 | PAX3 | NM_181457.3(PAX3): c.251C>T (p.Ser84Phe) | CCCACGCTGCGTCTYCAAGATC, CCACGGCTGCGTCTYCAAGATCC | Waardenburg syndrome type 1, Klein-Waardenberg syndrome |
| 121917718 | PAX4 | NM_006193.2(PAX4): c.490C>T (p.Arg164Trp) | CCACCCAGGGACCGGCCACYGGA, CCAGGGACCGGCCACYGGAATC | Maturity-onset diabetes of the young, type 9 |
| 121907929 | PAX6 | NM_000280.4(PAX6): c.771G>A (p.Trp257Ter) | CCAGGGACCGGCCACYGGAATCG, GGTATGRTTTTCTAATCGAAGGG, AGGTATGRTTTTCTAATCGAAGG | Aniridia, cerebellar ataxia, and mental retardation |
| 121907912 | PAX6 | NM_000280.4(PAX6): c.406C>T (p.Gln136Ter) | CCTGGCTAGCGAAAAGCAAYAGA | Congenital aniridia |
| 121907917 | PAX6 | NM_000280.4(PAX6): c.718C>T (p.Arg240Ter) | CCAGATGTGTTTGCCYGAGAAAG | Congenital aniridia |
| 28933972 | PAX9 | NM_006194.3(PAX9): c.76C>T (p.Arg26Trp) | CCGCTGCCCAACGCCATCYGGCT | Tooth agenesis, selective, 3 |
| 113994143 | PC | NM_000920.3(PC): c.1351C>T (p.Arg451Cys) | CCCTTGCGGAGTTCYGCGTCCGA | Pyruvate carboxylase deficiency |
| 115117837 | PCBD1 | NM_000281.3(PCBD1): c.263G>A (p.Arg88Gln) | CCAGGTTTATGTCYGTTCTGAA | Hyperphenylalaninemia, BH4-deficient, D |
| 121913014 | PCBD1 | NM_000281.3(PCBD1): c.236C>T (p.Thr79Ile) | CCACATCACGCTGAGCAYCCATG | Hyperphenylalaninemia, BH4-deficient, D |
| 121913015 | PCBD1 | NM_000281.3(PCBD1): c.292C>T (p.Gln98Ter) | CCTGGCCAGCTTCATCGAAYAAG, CCAGCTTCATCGAAYAAGTAGCA | Hyperphenylalaninemia, BH4-deficient, D |
| 121964960 | PCCB | NM_000532.4(PCCB): c.502G>A (p.Glu168Lys) | CCAARAAGGAGTGGAGTCTTTGG | Propionic acidemia |
| 398123460 | PCCB | NM_000532.4(PCCB): c.183+1G>A | ACAAGCGARTGAGTCCTGAGGGG | Propionic acidemia, not provided |
| 398123464 | PCCB | NM_000532.4(PCCB): c.3G>A (p.Met1Ile) | AATRGCGGCGGCATTACGGGTGG, AAAAATRGCGGCGGCATTACGGG, CAAAAATRGCGGCGGCATTACGG | Propionic acidemia, not provided |
| 374722096 | PCCB | NM_000532.4(PCCB): c.683C>T (p.Pro228Leu) | CCTGTTCATCACTGGCCYTGATG | Propionic acidemia |
| 202247820 | PCCB | NM_000532.4(PCCB): c.1495C>T (p.Arg499Ter) | CCCTTTCCTGCAGCAGTGYGAG, CCTTTCCTGCAGCAGTGYGAGG | Propionic acidemia |
| 186710233 | PCCB | NM_000532.4(PCCB): c.1534C>T (p.Arg512Cys) | CCAACCTTCTTCCACAYGTGCCC | Propionic acidemia |
| 132630324 | PCDH19 | NM_001184880.1(PCDH19): c.253C>T (p.Gln85Ter) | CCTGCTGGTCACCAAGYAGAAGA | Early infantile epileptic encephalopathy 9 |
| 796052811 | PCDH19 | NM_001105243.1(PCDH19): c.1031C>T (p.Pro344Leu) | CCAATGACAATCCGCYGGTCATC | not provided |
| 119479062 | PCNT | NM_006031.5(PCNT): c.5767C>T (p.Arg1923Ter) | CCCGAGCTGCAGTGGCTCYGAGC, CCGAGCTGCAGTGGCTCYGAGCG | Microcephalic osteodysplastic primordial dwarfism type 2 |
| 587784321 | PCNT | NM_006031.5(PCNT): c.8917C>T (p.Arg2973Ter) | CCACCTCCGGGAACAGCAGYGAG, CCTCCGGGAACAGCAGYGAGC | Microcephalic osteodysplastic primordial dwarfism type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794728683 | PCSK9 | NM_174936.3(PCSK9): c.644G>A (p.Arg215His) | CGGGACCCRCTTCCACAGACAGG | not provided |
| 374603772 | PCSK9 | NM_174936.3(PCSK9): c.1486C>T (p.Arg496Trp) | CCAGGAGTGGGAAGCGGYGGGGC | not provided |
| 587777189 | PCYT1A | NM_005017.3(PCYT1A): c.296C>T (p.Ala99Val) | CTTCRCTTGCATCAGAGCTCGGG, TCTTCRCTTGCATCAGAGCTCGG | Spondylometaphyseal dysplasia with cone-rod dystrophy |
| 794726867 | PDE3A | NM_000921.4(PDE3A): c.1340C>T (p.Ala447Val) | CCACCACCACCTCGGYCACAGGT | Brachydactyly with hypertension |
| 397515433 | PDE4D | NM_001165899.1(PDE4D): c.728C>T (p.Ala243Val) | CCGTCAGTGAGATGGYCTCCAAC | Acrodysostosis 2, with or without hormone resistance |
| 794727139 | PDE6A | NM_000440.2(PDE6A): c.1926+1G>A | CGAGRTAGGATGAGGGCCAAGGG, ACGAGRTAGGATGAGGGCCAAGG | Retinitis pigmentosa 43 |
| 121918578 | PDE6A | NM_000440.2(PDE6A): c.1683G>A (p.Trp561Ter) | CTGRCGGCACGGCTTCAACGTGG | Retinitis pigmentosa 43 |
| 121918581 | PDE6B | NM_000283.3(PDE6B): c.1669C>T (p.His557Tyr) | CCGGAGAATCACCTACYACAACT | Retinitis pigmentosa, Retinitis pigmentosa 40 |
| 397515633 | PDGFB | NM_002608.2(PDGFB): c.445C>T (p.Arg149Ter) | CCCCACCCAGGTGCAGCTGYGAC, CCCACCCAGGTGCAGCTGYGACC, CCACCCAGGTGCAGCTGYGACCT, CCCAGGTGCAGCTGYGACCTGTC | Idiopathic basal ganglia calcification 5 |
| 121908587 | PDGFRA | NM_006206.4(PDGFRA): c.2021C>T (p.Thr674Ile) | CCCCATTTACATCATCAYAGAGT, CCCATTTACATCATCAYAGAGTA, CCATTTACATCATCAYAGAGTAT | |
| 397509382 | PDGFRB | NM_002609.3(PDGFRB): c.2959C>T (p.Arg987Trp) | CCACCCAGCCATCCTTYGGTCCC | Basal ganglia calcification, idiopathic, 4 |
| 137853250 | PDHA1 | NM_000284.3(PDHA1): c.1133G>A (p.Arg378His) | AAGTTCRTGGTGCCAATCAGTGG | Pyruvate dehydrogenase E1-alpha deficiency |
| 137853252 | PDHA1 | NM_000284.3(PDHA1): c.904C>T (p.Arg302Cys) | CCCTCCCCATAGTTACYGTACAC, CCTCCCCATAGTTACYGTACACG | Pyruvate dehydrogenase E1-alpha deficiency, not provided |
| 121917722 | PEPD | NM_000285.3(PEPD): c.551G>A (p.Arg184Gln) | CTGAAGCCRAGTGTTTAAGACGG | Prolidase deficiency |
| 121917724 | PEPD | NM_000285.3(PEPD): c.1342G>A (p.Gly448Arg) | TTGGCRGGGTGAGTGCCCACGGG, TTTGGCRGGGTGAGTGCCCACGG | Prolidase deficiency |
| 61750420 | PEX1 | NM_000466.2(PEX1): c.2528G>A (p.Gly843Asp) | TTGRTGGGTTACATGAAGTTAGG | Leber amaurosis, Zellweger syndrome, Peroxisome biogenesis disorders, Zellweger syndrome spectrum, not provided |
| 267608183 | PEX10 | NM_002617.3(PEX10): c.600+1G>A | TACRTAAGTAGCAGGCGCTGAGG | Peroxisome biogenesis disorder 6A |
| 397515419 | PEX11B | NM_003846.2(PEX11B): c.64C>T (p.Gln22Ter) | CCTCTCCTCTAGGGCCGCCYAGT, CCTCTAGGGCCGCCYAGTATGCT | Peroxisome biogenesis disorder 14B |
| 61752112 | PEX12 | NM_000286.2(PEX12): c.949C>T (p.Leu317Phe) | CCGGGTGAATGATACTGTTYTTG | |
| 61752127 | PEX2 | NM_001079867.1(PEX2): c.669G>A (p.Trp223Ter) | TCATGRTGTATTCCTCTTACTGG | Peroxisome biogenesis disorder 5B |
| 28940308 | PEX26 | NM_017929.5(PEX26): c.265G>A (p.Gly89Arg) | TGTTGTGRGGATCCAGGCCCTGG | Peroxisome biogenesis disorder 7A |
| 62641228 | PEX26 | NM_017929.5(PEX26): c.292C>T (p.Arg98Trp) | CCCTGGCAGAAATGGATYGGTGG, CCTGGCAGAAATGGATYGGTGGC | Peroxisome biogenesis disorder 7B |
| 61752137 | PEX5 | NM_000319.4(PEX5): c.1255C>T (p.Arg419Ter) | CCTGTGAAACCCTAYGAGACTGG | Peroxisome biogenesis disorder 2A |
| 267608241 | PEX6 | NM_000287.3(PEX6): c.2440C>T (p.Arg814Ter) | CCCCAAGCCGGGGGYGAAGTGGA | Peroxisome biogenesis disorder 4A |
| 267608252 | PEX7 | NM_000288.3(PEX7): c.-45C>T | CCTCCGACTCGGAAYGGCTTCCG | Phytanic acid storage disease |
| 587776970 | PGAP2 | NM_001145438.2(PGAP2): c.479C>T (p.Thr160Ile) | CCACTACCTCAGCTGCAYCTCCC | Hyperphosphatasia with mental retardation syndrome 3 |
| 587777251 | PGAP3 | NM_033419.4(PGAP3): c.275G>A (p.Gly92Asp) | CCCTCCAACTCACCTTGYCATGG, CCTCCAACTCACCTTGYCATGGA | Hyperphosphatasia with mental retardation syndrome 4 |
| 431905503 | PGK1 | NM_000291.3(PGK1): c.756+5G>A | GGTAGRAAACAAATGCCAAGTGG | Phosphoglycerate kinase 1 deficiency |
| 132630299 | PHF6 | NM_001015877.1(PHF6): c.134G>A (p.Cys45Tyr) | TAAGTRCATGGTAAGTATACCGG | Boijeson-Forssman-Lehmann syndrome |
| 587777483 | PHGDH | NM_006623.3(PHGDH): c.488G>A (p.Arg163Gln) | CTACCCRGATGCAGTCCTTTGGG, GCTACCCRGATGCAGTCCTTTGG | Neu-Laxova syndrome 1 |
| 587777770 | PHGDH | NM_006623.3(PHGDH): c.418G>A (p.Gly140Arg) | TTCATGRGAACAGAGCTGAATGG | Neu-Laxova syndrome 1, not provided |
| 587777774 | PHGDH | NM_006623.3(PHGDH): c.793G>A (p.Glu265Lys) | GCAGRAGCCGCCACGGGACCGGG, GGCAGRAGCCGCCACGGGACCGG | Neu-Laxova syndrome 1 |
| 267606948 | PHGDH | NM_006623.3(PHGDH): c.1129G>A (p.Gly377Ser) | CATTGTCRGCCTCCTGAAAGAGG | Phosphoglycerate dehydrogenase deficiency |
| 137853590 | PHKG2 | NM_000294.2(PHKG2): c.130C>T (p.Arg44Ter) | CCGCCGTTGTGTTCATYGAGCTA | Glycogen storage disease IXc |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894269 | PHOX2A | NM_005169.3(PHOX2A): c.215C>T (p.Ala72Val) | CCCGCGCCCTACTCGGYAGGTGA, CCGCGCCCTACTCGGYAGGTGAG | Fibrosis of extraocular muscles, congenital, 2 |
| 587777764 | PIEZO1 | NM_001142864.3(PIEZO1): c.6059C>T (p.Ala2020Val) | GAGGRCGCGGTCAACCACCATGG | Xerocytosis |
| 587777450 | PIEZO2 | NM_022068.3(PIEZO2): c.8057G>A (p.Arg2686His) | CCCACTGAAGAATTCAYGGACAA, CCACTGAAGAATTCAYGGACAAA | Gordon syndrome |
| 368953604 | PIGO | NM_032634.3(PIGO): c.3069+5G>A | CCCTGATCTCTCTCCTACAYCCA, CCTGATCTCTCTCCTACAYCCAC | Hyperphosphatasia with mental retardation syndrome 2 |
| 527236031 | PIGT | NM_015937.5(PIGT): c.1342C>T (p.Arg448Trp) | CCATCCAGTTTGAGYGGGCGCTG | Multiple congenital anomalies-hypotonia-seizures syndrome 3 |
| 397514565 | PIK3CA | NM_006218.2(PIK3CA): c.1133G>A (p.Cys378Tyr) | CCTTRTTCCAATCCCAGGTAAGG | Megalencephaly cutis marmorata telangiectatica congenita, PIK3CA Related Overgrowth Spectrum |
| 121913273 | PIK3CA | NM_006218.2(PIK3CA): c.1624G>A (p.Glu542Lys) | TCTCTCTRAAATCACTGAGCAGG | Congenital lipomatous overgrowth, vascular malformations, and epidermal nevi, Non-small cell lung cancer, Neoplasm of ovary |
| 587777389 | PIK3CD | NM_005026.3(PIK3CD): c.1573G>A (p.Glu525Lys) | GTATRAGCACGAGAAGGACCTGG | Activated PI3K-delta syndrome |
| 121918337 | PIKFYVE | NM_015040.3(PIKFYVE): c.2962C>T (p.Gln988Ter) | CCCTGTGGATGACCAAYAAGATG, CCTGTGGATGACCAAYAAGATGC | Fleck corneal dystrophy |
| 121909109 | PITX1 | NM_002653.4(PITX1): c.388G>A (p.Glu130Lys) | CCTCACCRAGCCGCGCGTGCGGG, ACCTCACCRAGCCGCGCGTGCGG | Talipes equinovarus |
| 104893861 | PITX2 | NM_153427.2(PITX2): c.206G>A (p.Arg69His) | CACRCGAAGAAATCGCTGTGTGG | Iridogoniodysgenesis, dominant type |
| 121909248 | PITX2 | NM_153427.2(PITX2): c.250C>T (p.Arg84Trp) | CCTTACGGAAGCCCGAGTCYGGG | Iridogoniodysgenesis, dominant type |
| 199476102 | PKD1 | NM_001009944.2(PKD1): c.12420G>A (p.Trp4140Ter) | CCTCTGRATGGGCCTCAGCAAGG | Polycystic kidney disease, adult type |
| 199476095 | PKD1 | NM_001009944.2(PKD1): c.12682C>T (p.Arg4228Ter) | CCTGCTCACCCAGTTTGACYGAC | Polycystic kidney disease, adult type |
| 199476096 | PKD1 | NM_001009944.2(PKD1): c.11512C>T (p.Gln3838Ter) | CCGGCTGCGCTTCCTGYAGCTGC | Polycystic kidney disease, adult type |
| 121918042 | PKD2 | NM_000297.3(PKD2): c.1390C>T (p.Arg464Ter) | CCTTTAAAGCTGATCYGATATGT | Polycystic kidney disease 2 |
| 794727680 | PKHD1 | NM_138694.3(PKHD1): c.7194G>A (p.Trp2398Ter) | ACAGTTTGRGAAAGTGCAGGTGG | Polycystic kidney disease, infantile type |
| 786204241 | PKHD1 | NM_138694.3(PKHD1): c.8303-1G>A | CACARACAGAACTGTCCTTGTGG | Polycystic kidney disease, infantile type |
| 398124479 | PKHD1 | NM_138694.3(PKHD1): c.2407+1G>A | TTCTGRTAAAGGGGTGATTGGGG, TTTCTGRTAAAGGGGTGATTGGG, ATTTCTGRTAAAGGGGTGATTGG | Polycystic kidney disease, infantile type, not provided |
| 137852946 | PKHD1 | NM_138694.3(PKHD1): c.5221G>A (p.Val1741Met) | ACAGCARTGACGGAGAACTTCGG | Polycystic kidney disease, infantile type, not provided |
| 28937907 | PKHD1 | NM_138694.3(PKHD1): c.4991C>T (p.Ser1664Phe) | CCAGAATTGATCTCTATTTYTCA | Polycystic kidney disease, infantile type |
| 773136605 | PKHD1 | NM_138694.3(PKHD1): c.2854G>A (p.Gly952Arg) | CCAGAGAAACCAGTTCYGGTAAT | Polycystic kidney disease, infantile type |
| 727504096 | PKHD1 | NM_138694.3(PKHD1): c.370C>T (p.Arg124Ter) | CCAAATCCAGGACCAYGAGATAG | Polycystic kidney disease, infantile type, not provided |
| 398124478 | PKHD1 | NM_138694.3(PKHD1): c.2341C>T (p.Arg781Ter) | CCTGGTGACGACACAGAYGAC | Polycystic kidney disease, infantile type, not provided |
| 398124480 | PKHD1 | NM_138694.3(PKHD1): c.2452C>T (p.Gln818Ter) | CCTTCACCAGCTCTTAYAGAATA | Polycystic kidney disease, infantile type, not provided |
| 137852944 | PKHD1 | NM_138694.3(PKHD1): c.107C>T (p.Thr36Met) | CCTTGCAGGGGAAYGTGGATCA | Polycystic kidney disease, infantile type, not provided |
| 137852945 | PKHD1 | NM_138694.3(PKHD1): c.9053C>T (p.Ser3018Phe) | CCTGGATCATATCATYTACTCTG | Polycystic kidney disease, infantile type |
| 137852947 | PKHD1 | NM_138694.3(PKHD1): c.8011C>T (p.Arg2671Ter) | CCTCCTAAGATGTGGGAGTYGAG, CCTAAGATGTGGGAGTYGAGTGG | Polycystic kidney disease, infantile type |
| 118204085 | PKLR | NM_000298.5(PKLR): c.1436G>A (p.Arg479His) | TGGCCRGTGAGGGGGATATTGGG, CTGGCCRGTGAGGGGGATATTGG | |
| 116100695 | PKLR | NM_000298.5(PKLR): c.1456C>T (p.Arg486Trp) | TCGGTACCRAGACAGAAGCTGGG | Pyruvate kinase deficiency of red cells |
| 118204083 | PKLR | NM_000298.5(PKLR): c.487C>T (p.Arg163Cys) | CCAAGGGACCGGAGATCYGCACT | Pyruvate kinase deficiency of red cells |
| 74315362 | PKLR | NM_000298.5(PKLR): c.1151C>T (p.Thr384Met) | CCAAGCCCCGGCCAAYGAGGGCA | Pyruvate kinase deficiency of red cells |
| 121918354 | PKP1 | NM_000299.3(PKP1): c.910C>T (p.Gln304Ter) | CCCCAACCAGAACGTCYAGCAGG, CCAACCAGAACGTCYAGCAGGC, CCAACCAGAACGTCYAGCAGGCC | Ectodermal dysplasia skin fragility syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 766209297 | PKP2 | NM_004572.3(PKP2): c.1162C>T (p.Arg388Trp) | TCTTCCRAGCTTCAGATTTCTGG | not provided |
| 794729103 | PKP2 | NM_004572.3(PKP2): c.517C>T (p.Gln173Ter) | CCAGTACAGCCAGAGAAGCYAGG | not provided |
| 121908686 | PLA2G6 | NM_003560.2(PLA2G6): c.2222G>A (p.Arg741Gln) | GGCRGGCTGTGGACCGGGCACGG, AGACGGGCRGGCTGTGGACCGGG | Parkinson disease 14 |
| 370691849 | PLA2G6 | NM_003560.2(PLA2G6): c.1612C>T (p.Arg538Cys) | CATGCCGCRCATGTAGGCCATGG | Iron accumulation in brain |
| 121908683 | PLA2G6 | NM_003560.2(PLA2G6): c.1894C>T (p.Arg632Trp) | CCTAGACCAGCTGGTGTGGYGGG | Karak syndrome |
| 587784338 | PLA2G6 | NM_003560.2(PLA2G6): c.1754C>T (p.Thr585Ile) | CCAGGGTGATGCTGAYAGGGACA | Iron accumulation in brain |
| 587784357 | PLA2G6 | NM_003560.2(PLA2G6): c.517C>T (p.Gln173Ter) | CCTGGTGGAGCTGGTGYAGTACT | Iron accumulation in brain |
| 397514770 | PLCB4 | NM_001172646.1(PLCB4): c.1078G>A (p.Asp360Asn) | CTTRACTGCTGGGATGGAAAAGG | Auriculocondylar syndrome 2 |
| 397514470 | PLCD1 | NM_006225.3(PLCD1): c.1246C>T (p.Arg416Ter) | CCCCATGCTGTTGAACYGACCAC, CCCATGCTGTTGAACYGACCACT, CCATGCTGTTGAACYGACCACTG | Leukonychia totalis |
| 121912605 | PLCE1 | NM_016341.3(PLCE1): c.4451C>T (p.Ser1484Leu) | CCTGCCAATCATCATATYGATTG | Nephrotic syndrome, type 3 |
| 137853160 | PLEC | NM_000445.4(PLEC): c.913C>T (p.Gln305Ter) | CCTGCCCGCAGGAGCTGYAGCTG | Epidermolysis bullosa simplex with pyloric atresia |
| 387906801 | PLEC | NM_000445.4(PLEC): c.6169C>T (p.Gln2057Ter) | CCTGCGGGAGCGAGCGGAGYAGG | Epidermolysa bullosa simplex and limb girdle muscular dystrophy |
| 387906802 | PLEC | NM_000445.4(PLEC): c.6955C>T (p.Arg2319Ter) | CCCAAGAGGCTGCGYGACTGCGG | Epidermolysa bullosa simplex and limb girdle muscular dystrophy |
| 786205055 | PLEKHM1 | NM_014798.2(PLEKHM1): c.296+1G>A | CAARTGAGATTTAGCTGGAGAGG, ACCCACAARTGAGATTTAGCTGG | Osteopetrosis autosomal recessive 6 |
| 121918027 | PLG | NM_000301.3(PLG): c.1858G>A (p.Ala620Thr) | GTTGACTRCTGCCCACTGCTTGG | Dysplasminogenemia |
| 121918030 | PLG | NM_000301.3(PLG): c.704G>A (p.Arg235His) | TTACTGTCRTAACCCCGATAGGG | Plasminogen deficiency, type I |
| 121913550 | PLOD1 | NM_000302.3(PLOD1): c.955C>T (p.Arg319Ter) | CCCCCAGAAACACATGYGACTTT, CCCCAGAAACACATGYGACTTTT, CCCAGAAACACATGYGACTTTTC | Ehlers-Danlos syndrome, hydroxylysine-deficient |
| 132630278 | PLP1 | NM_001128834.2(PLP1): c.646C>T (p.Pro216Ser) | CCCATGGAATGCTTTCYCTGGCA, CCATGGAATGCTTTCYCTGGCAA | Pelizaeus-Merzbacher disease, not provided |
| 132630293 | PLP1 | NM_001128834.2(PLP1): c.725C>T (p.Ala242Val) | CCTTCCACCTGTTTATTGYTGCA, CCACCTGTTTATTGYTGCATTTG | |
| 132630294 | PLP1 | NM_001128834.2(PLP1): c.509C>T (p.Ser170Phe) | CCTGGTGTTTGCCTGCTYTGCTG | Spastic paraplegia 2 |
| 80338707 | PMM2 | NM_000303.2(PMM2): c.691G>A (p.Val231Met) | CTACTCCRTGACAGCGCCTGAGG | Carbohydrate-deficient glycoprotein syndrome type I, not provided |
| 104894621 | PMP22 | NM_000304.3(PMP22): c.215C>T (p.Ser72Leu) | CCACCATGATCCTGTYGATCATC | Dejerine-Sottas disease, Dejerine-Sottas syndrome, autosomal dominant |
| 587778617 | PMS2 | NM_000535.5(PMS2): c.1261C>T (p.Arg421Ter) | CCATTTCCAGACTGYGAGAGGCC | Hereditary Nonpolyposis Colorectal Neoplasms, not specified |
| 267606956 | PNKP | NM_007254.3(PNKP): c.976G>A (p.Glu326Lys) | CTGAGRAGTTCTTTCTCAAGTGG | Early infantile epileptic encephalopathy 10, not provided |
| 104894453 | PNP | NM_000270.3(PNP): c.265G>A (p.Glu89Lys) | TGTATRAAGGGTACCCACTCTGG | Purine-nucleoside phosphorylase deficiency |
| 121918260 | PNPLA2 | NM_020376.3(PNPLA2): c.865C>T (p.Gln289Ter) | CCAAGCGGAGGATTACTCGYAGC | Neutral lipid storage disease with myopathy |
| 142422525 | PNPLA6 | NM_006702.4(PNPLA6): c.3382G>A (p.Gly1128Ser) | TGTCCRGCTGGTGGCTGCTGTGG | Trichomegaly with mental retardation, dwarfism and pigmentary degeneration of retina |
| 587777185 | PNPLA6 | NM_006702.4(PNPLA6): c.2375G>A (p.Gly792Glu) | GTCAGRGTGGCTGGCCCAGCAGG | Spastic paraplegia 39 |
| 786201037 | PNPLA6 | NM_006702.4(PNPLA6): c.3152G>A (p.Arg1051Gln) | TGCRAGTCCACAAAGATGGTGGG, ATGCRAGTCCACAAAGATGGTGG, GCCATGCRAGTCCACAAAGATGG | Trichomegaly with mental retardation, dwarfism and pigmentary degeneration of retina |
| 587777181 | PNPLA6 | NM_006702.4(PNPLA6): c.3029C>T (p.Thr1010Ile) | CCTCACGTACCCAGTCAYCTCCA | Boucher Neuhauser syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777854 | PNPLA6 | NM_006702.4(PNPLA6): c.3295C>T (p.Arg1099Cys) | CCCCACAGCGGACATCGCCYGCA, CCCACAGCGGACATCGCCYGCAG, CCACAGCGGACATCGCCYGCAGC | Boucher Neuhauser syndrome |
| 773450573 | PNPO | NM_018129.3(PNPO): c.686G>A (p.Arg229Gln) | GACCRGATAGTCTTTCGGCGGGG, TGACCRGATAGTCTTTCGGCGGG, ATGACCRGATAGTCTTTCGGCGG | not provided |
| 104894629 | PNPO | NM_018129.3(PNPO): c.685C>T (p.Arg229Trp) | CCAACCGCCTGCATGACYGGATA | "Pyridoxal 5-phosphate-dependent epilepsy" |
| 397514487 | POC1A | NM_015426.4(POC1A): c.241C>T (p.Arg81Ter) | CCTGCTTGCTTCCGGCTCCYGAG | Short stature, onychodysplasia, facial dysmorphism, and hypotrichosis, Primordial dwarfism |
| 587777293 | POGLUT1 | NM_152305.2(POGLUT1): c.11G>A (p.Trp4Ter) | GGTRGGCTAGCTCGCCGCTTCGG | Dowling-degos disease 4 |
| 199759055 | POLG | NM_002693.2(POLG): c.1156C>T (p.Arg386Cys) | GTTCTCACRAATGTCCTTCATGG | not provided |
| 769410130 | POLG | NM_002693.2(POLG): c.915C>G (p.Ser305Arg) | GAAGCTRCTTAGCCCTGAGATGG | not provided |
| 796052888 | POLG | NM_002693.2(POLG): c.2558G>A (p.Arg853Gln) | GCCRGGCTGTGGAGCCCACATGG | not provided |
| 121918055 | POLG | NM_002693.2(POLG): c.1532G>A (p.Ser511Asn) | CCARCAAGTTGCCCATCGAGGGG, GCCARCAAGTTGCCCATCGAGGG, AGCCARCAAGTTGCCCATCGAGG | Autosomal dominant progressive external ophthalmoplegia with mitochondrial DNA deletions 1 |
| 144500145 | POLG | NM_002693.2(POLG): c.2554C>T (p.Arg852Cys) | AGCCCGGCRAGTGATGGTGCCGG | Sensory ataxic neuropathy, dysarthria, and ophthalmoparesis, Cerebellar ataxia infantile with progressive external ophthalmoplegia, not provided |
| 113994098 | POLG | NM_002693.2(POLG): c.2542G>A (p.Gly848Ser) | TGCCRGCACCATCACTCGCCGGG, CTGCCRGCACCATCACTCGCCGG | Progressive sclerosing poliodystrophy, Cerebellar ataxia infantile with progressive external ophthalmoplegia, Mitochondrial DNA depletion syndrome 4B, MNGIE type, not provided |
| 56047213 | POLG | NM_002693.2(POLG): c.3406G>A (p.Glu1136Lys) | CCAGGTAGCGAACCTYGTCATGG | not provided |
| 121918053 | POLG | NM_002693.2(POLG): c.2557C>T (p.Arg853Trp) | CCGGCACCATCACTCGCYGGGCT | Cerebellar ataxia infantile with progressive external ophthalmoplegia, not provided |
| 121918056 | POLG | NM_002693.2(POLG): c.679C>T (p.Arg227Trp) | CCTGGTGCAGCCAGYGGCTGGTG | Mitochondrial DNA depletion syndrome 4B, MNGIE type |
| 113994094 | POLG | NM_002693.2(POLG): c.752C>T (p.Thr251Ile) | CCCCTGGAGGTCCCTAYTGGTG, CCCCTGGAGGTCCCTAYTGGTGC, CCCTGGAGGTCCCTAYTGGTGCC, CCTGGAGGTCCCTAYTGGTGCCA | Myoneural gastrointestinal encephalopathy syndrome, Progressive sclerosing poliodystrophy, Cerebellar ataxia infantile with progressive external ophthalmoplegia, Mitochondrial DNA depletion syndrome 4B, MNGIE type, not specified, not provided |
| 113994096 | POLG | NM_002693.2(POLG): c.1760C>T (p.Pro587Leu) | CCCTGCATGGACCCYGGGCCCCA | Myoneural gastrointestinal encephalopathy syndrome, Cerebellar ataxia infantile with progressive external ophthalmoplegia, Mitochondrial DNA depletion syndrome 4B, MNGIE type, not specified, not provided |
| 141156009 | POLR1C | NM_203290.2(POLR1C): c.835C>T (p.Arg279Trp) | CCAGAGTTGCCAACCCCYGGCTG | Mandibulofacial dysostosis, Treacher Collins type, autosomal recessive |
| 796052126 | POLR1C | NM_203290.2(POLR1C): c.77C>T (p.Thr26Ile) | CCTTTGCTCTAGGTCCATAYTAC | LEUKODYSTROPHY, HYPOMYELINATING, 11 |
| 267608673 | POLR3A | NM_007055.3(POLR3A): c.1114G>A (p.Asp372Asn) | TCTCGCCCRACCCCAACCTCCGG | Hypomyelinating leukodystrophy 7 |
| 267608677 | POLR3A | NM_007055.3(POLR3A): c.1909+18G>A | GAACTCRGGTGGGAGAAGGAGG | Hypomyelinating leukodystrophy 7 |
| 267608680 | POLR3A | NM_007055.3(POLR3A): c.3991G>A (p.Ala1331Thr) | TCTTTGACRCTGCCTACTTCGGG | Hypomyelinating leukodystrophy 7 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267608678 | POLR3A | NM_007055.3(POLR3A): c.418C>T (p.Arg140Ter) | CCTGACCTACCTTCAGAAGYGAG, CCTACCTTCAGAAGYGAGGACTG | Hypomyelinating leukodystrophy 7 |
| 387907299 | POMGNT2 | NM_032806.5(POMGNT2): c.1333C>T (p.Arg445Ter) | CCCCGAGTGGCTCTTCYGAATCT, CCCGAGTGGCTCTTCYGAATCTA, CCGAGTGGCTCTTCYGAATCTAC | Congenital muscular dystrophy-dystroglycanopathy with brain and eye anomalies, type A8 |
| 28941782 | POMT1 | NM_007171.3(POMT1): c.226G>A (p.Gly76Arg) | CTTGRGAGGTAGGAGTCATCAGG | Walker-Warburg congenital muscular dystrophy |
| 397515400 | POMT1 | NM_007171.3(POMT1): c.1241C>T (p.Thr414Met) | CCACCCGCTCCCTGAACAYGTGA, CCCGCTCCCTGAACAYGTGAGTG, CCGCTCCCTGAACAYGTGAGTGT | Limb-girdle muscular dystrophy-dystroglycanopathy, type C1 |
| 267606969 | POMT2 | NM_013382.5(POMT2): c.2177G>A (p.Gly726Glu) | TTACGRGATGGTTGGTCCCCTGG | Congenital muscular dystrophy-dystroglycanopathy with brain and eye anomalies, type A2, Congenital muscular dystrophy-dystroglycanopathy with mental retardation, type B2 |
| 119463989 | POMT2 | NM_013382.5(POMT2): c.1912C>T (p.Arg638Ter) | CCCAGGTCCTGCTGYGAGGAGGC | Congenital muscular dystrophy-dystroglycanopathy with brain and eye anomalies, type A2 |
| 533916138 | POMT2 | NM_013382.5(POMT2): c.1006+1G>A | CCCAGAGACACTCAYGTTCAGGG | Congenital muscular dystrophy-dystroglycanopathy with brain and eye anomalies, type A2 |
| 786205099 | POR | NM_000941.2(POR): c.731+1G>A | CCAGRTGAGCAAGTGCCCGCAGG | Antley-Bixler syndrome with genital anomalies and disordered steroidogenesis |
| 28931607 | POR | NM_000941.2(POR): c.1706G>A (p.Cys569Tyr) | CGGCTRCCGCCGCTCGGATGAGG | Disordered steroidogenesis due to cytochrome p450 oxidoreductase deficiency |
| 104893755 | POU1F1 | NM_001122757.2(POU1F1): c.889C>T (p.Arg297Trp) | CCGGAGGCAGAGAGAAAAAYGGG | Pituitary hormone deficiency, combined 1 |
| 104893757 | POU1F1 | NM_001122757.2(POU1F1): c.71C>T (p.Pro24Leu) | CCTCTGCAACTCTGCYTCTGATA | Pituitary hormone deficiency, combined 1 |
| 111033345 | POU3F4 | NM_000307.4(POU3F4): c.499C>T (p.Arg167Ter) | CCTGCACCCGGTGCTCYGAGAGC | Deafness, X-linked 2 |
| 121909056 | POU4F3 | NM_002700.2(POU4F3): c.865C>T (p.Leu289Phe) | CCGGAGAAGCGTTCAYTCGAGGC | Deafness, autosomal dominant 15 |
| 72551362 | PPARG | NM_138712.3(PPARG): c.868G>A (p.Val290Met) | TCGCTCCRTGGAGGCTGTGCAGG | Lipodystrophy, familial partial, type 3 |
| 121918325 | PPDX | NM_001122764.1(PPDX): c.502C>T (p.Arg168Cys) | CCATGGACAGTCTCTGCYGTGGA | Variegate porphyria |
| 387907110 | PRDM5 | NM_018699.3(PRDM5): c.1768C>T (p.Arg590Ter) | CCTGAAGAAAATGCTGATTYGAC | Brittle cornea syndrome 2 |
| 104894176 | PRF1 | NM_001083116.1(PRF1): c.1122G>A (p.Trp374Ter) | CTCGCTGRAGGGACTGCAGCCGG | Hemophagocytic lymphohistiocytosis, familial, 2, Malignant lymphoma, non-Hodgkin |
| 104894180 | PRF1 | NM_001083116.1(PRF1): c.190C>T (p.Gln64Ter) | CCTTCCCAGTGGACACAYAAAGG | Hemophagocytic lymphohistiocytosis, familial, 2 |
| 35418374 | PRF1 | NM_001083116.1(PRF1): c.11G>A (p.Arg4His) | CCCAGGAGGAGCAGAYGGGCTGC, CCAGGAGGAGCAGAYGGGCTGCC | Aplastic anemia |
| 113994140 | PRICKLE1 | NM_153026.2(PRICKLE1): c.311G>A (p.Arg104Gln) | CAGCRGAAGAAAGAAGCACTGGG, TCAGCRGAAGAAAGAAGCACTGG | Progressive myoclonus epilepsy with ataxia |
| 587776773 | PRKAR1A | NM_002734.4(PRKAR1A): c.-7+1G>A | CAGRTGAGTGGGGTCGGCCGGGG, CCAGRTGAGTGGGGTCGGCCGGG, CCCAGRTGAGTGGGGTCGGCCGG | Pigmented nodular adrenocortical disease, primary, 1 |
| 281864780 | PRKAR1A | NM_212472.2(PRKAR1A): c.82C>T (p.Gln28Ter) | CCAGAAGCATAACATTYAAGCGC | Carney complex, type 1 |
| 398122958 | PRKCD | NM_006254.3(PRKCD): c.1352+1G>A | CACRTACGTAAGGGCCATGGTGG, TGCCACRTACGTAAGGGCCATGG | Common variable immunodeficiency 9 |
| 121918514 | PRKCG | NM_002739.3(PRKCG): c.353G>A (p.Gly118Asp) | ACTGTGRCTCCCTCCTCTACGGG, CACTGTGRCTCCCTCCTCTACGG | Spinocerebellar ataxia 14 |
| 386134164 | PRKCG | NM_002739.3(PRKCG): c.367G>A (p.Gly123Arg) | CTCTACRGGCTTGTGCACCAGGG, CCTCTACRGGCTTGTGCACCAGG | Spinocerebellar ataxia 14 |
| 386134165 | PRKCG | NM_002739.3(PRKCG): c.368G>A (p.Gly123Glu) | CTCTACRGGCTTGTGCACCAGGG, CCTCTACRGGCTTGTGCACCAGG | Spinocerebellar ataxia 14 |
| 386134167 | PRKCG | NM_002739.3(PRKCG): c.392G>A (p.Cys131Tyr) | AATRCTCCTGTGAGTGACCTGGG, AAATRCTCCTGTGAGTGACCTGG | Spinocerebellar ataxia 14 |
| 386134171 | PRKCG | NM_002739.3(PRKCG): c.1078G>A (p.Gly360Ser) | AAARGCAGTTTTGGGAAGGTTGG, AGGAAAARGCAGTTTTGGGAAGG | Spinocerebellar ataxia 14 |
| 121918511 | PRKCG | NM_002739.3(PRKCG): c.301C>T (p.His101Tyr) | CCAGGACCCCCGGAACAAAYACA | Spinocerebellar ataxia 14 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 142742242 | PROC | NM_000312.3(PROC): c.1201G>A (p.Asp401Asn) | GGGCRACAGTGGGGGCCCATGG | Thrombophilia, hereditary, due to protein C deficiency, autosomal dominant |
| 121918149 | PROC | NM_000312.3(PROC): c.226G>A (p.Val76Met) | AAAATRTGGATGACACAGTAAGG | Thrombophilia, hereditary, due to protein C deficiency, autosomal recessive |
| 121918144 | PROC | NM_000312.3(PROC): c.902C>T (p.Ala301Val) | CCACCGACAATGACATCGYACTG, CCGACAATGACATCGYACTGCTG | Thrombophilia, hereditary, due to protein C deficiency, autosomal recessive |
| 121918160 | PROC | NM_000312.3(PROC): c.935C>T (p.Ser312Leu) | CCCAGCCCGCCACCCTCTYGCAG, CCAGCCCGCCACCCTCTYGCAGA | Thrombophilia, hereditary, due to protein C deficiency, autosomal dominant |
| 757583846 | PROC | NM_000312.3(PROC): c.169C>T (p.Arg57Trp) | CCGTCACAGCAGCCTGGAGYGGG | Thrombophilia, hereditary, due to protein C deficiency, autosomal dominant |
| 3970559 | PRODH | NM_016335.4(PRODH): c.1357C>T (p.Arg453Cys) | CACRGGCTCGCTCCTGGGCCAGG, TGCCGCACRGGCTCGCTCCTGGG | Proline dehydrogenase deficiency, Schizophrenia 4 |
| 376142095 | PROKR2 | NM_144773.2(PROKR2): c.743G>A (p.Arg248Gln) | CCTTGAACCAGAGCTCCYGGGAG | |
| 137853006 | PROM1 | NM_006017.2(PROM1): c.1117C>T (p.Arg373Cys) | CCTGACAGAGTACAAYGCCAAAC | Bull eye macular dystrophy, Stargardt disease 4, Cone-rod dystrophy 12 |
| 137853100 | PROP1 | NM_006261.4(PROP1): c.296G>A (p.Arg99Gln) | GGCCCRAGAGAGTCTTGCCCGGG, GGGCCCRAGAGAGTCTTGCCCGG | Pituitary hormone deficiency, combined 2 |
| 121917843 | PROP1 | NM_006261.4(PROP1): c.217C>T (p.Arg73Cys) | CCCGGCGCCGCCACYGCACCACC | Pituitary hormone deficiency, combined 2 |
| 121917844 | PROP1 | NM_006261.4(PROP1): c.295C>T (p.Arg99Ter) | CCCGACATCTGGGCCYGAGAGA, CCCGACATCTGGGCCYGAGAGAG, CCGACATCTGGGCCYGAGAGAGT | Pituitary hormone deficiency, combined 2 |
| 794727001 | PRPF31 | NM_015629.3(PRPF31): c.1073+1G>A | CCGCAGRTGAGGGGCCCTGGGGG, GCCGCAGRTGAGGGGCCCTGGGG, GGCCGCAGRTGAGGGGCCCTGGG | Retinitis pigmentosa 11 |
| 587777599 | PRPF4 | NM_004697.4(PRPF4): c.944C>T (p.Pro315Leu) | CCTTTCCAGTGATGAACYAGTGG | Retinitis pigmentosa 70 |
| 61755789 | PRPH2 | NM_000322.4(PRPH2): c.500G>A (p.Gly167Asp) | CTGCGRCAACAACGGTTTTCGGG, GCTGCGRCAACAACGGTTTTCGG | Patterned dystrophy of retinal pigment epithelium, not provided |
| 121918566 | PRPH2 | NM_000322.4(PRPH2): c.947G>A (p.Trp316Ter) | GGAGACCTRGAAGGCCTTTCTGG | Macular dystrophy, vitelliform, adult-onset, not provided |
| 527236097 | PRPH2 | NM_000322.4(PRPH2): c.410G>A (p.Gly137Asp) | GAACGRCATGAAGTACTACCGGG, AGAACGRCATGAAGTACTACCGG | Retinitis pigmentosa |
| 527236098 | PRPH2 | NM_000322.4(PRPH2): c.499G>A (p.Gly167Ser) | CTGCRGCAACAACGGTTTTCGGG, GCTGCRGCAACAACGGTTTTCGG | Retinitis pigmentosa |
| 61755771 | PRPH2 | NM_000322.4(PRPH2): c.136C>T (p.Arg46Ter) | CCTGAAGATTGAACTCYGAAAGA | Retinitis pigmentosa 7, not provided |
| 61755806 | PRPH2 | NM_000322.4(PRPH2): c.647C>T (p.Pro216Leu) | CCTTTCAGCTGCTGCAATCYTAG | Retinitis pigmentosa 7, not provided |
| 387907125 | PRRT2 | NM_145239.2(PRRT2): c.950G>A (p.Ser317Asn) | TAARCATCGTGGCGCTGGTGGGG, TTAARCATCGTGGCGCTGGTGGG, CTTAARCATCGTGGCGCTGGTGG, GCTCTTAARCATCGTGGCGCTGG | Infantile convulsions and paroxysmal choreoathetosis, familial |
| 397514579 | PRRT2 | NM_145239.2(PRRT2): c.748C>T (p.Gln250Ter) | CCGCCACCCCAGCTCCYAGTTGG | Dystonia 10, Seizures, benign familial infantile, 2 |
| 387907127 | PRRT2 | NM_145239.2(PRRT2): c.487C>T (p.Gln163Ter) | CCAGAGCTCCCTACCYAGGAGGA | Dystonia 10, Infantile convulsions and paroxysmal choreoathetosis, familial, not provided |
| 730882158 | PRSS56 | NM_001195129.1(PRSS56): c.958G>A (p.Gly320Arg) | GCCCRGGGTCTACACCCGCGTGG | Microphthalmia, isolated 6 |
| 3814290 | PRX | NM_181882.2(PRX): c.1951G>A (p.Asp651Asn) | TGTGCCCRATGTGCACCTCCCGG | Charcot-Marie-Tooth disease, type IVF, not provided |
| 104894708 | PRX | NM_181882.2(PRX): c.3208C>T (p.Arg1070Ter) | CCTTCCTTTGGGCTGGCTYGAGG, CCTTTTGGGCTGGCTYGAGGGAAG | Dejerine-Sottas disease, Charcot-Marie-Tooth disease, type IVF |
| 121917807 | PSEN1 | NM_000021.3(PSEN1): c.796G>A (p.Gly266Ser) | GAAARGTCCACTTCGTATGCTGG | Alzheimer disease, familial, 3, with spastic paraparesis and apraxia |
| 63750577 | PSEN1 | NM_000021.3(PSEN1): c.509C>T (p.Ser170Phe) | CCTGGCTTATTATATCATYTCTA | Alzheimer disease, type 3, not provided |
| 63750048 | PSEN2 | NM_000447.2(PSEN2): c.254C>T (p.Ala85Val) | CCCTCAAATACGGAGYGAAGCAC, CCTCAAATACGGAGYGAAGCACG | Alzheimer disease, type 4, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 138911275 | PTCH1 | NM_000264.3(PTCH1): c.3155C>T (p.Thr1052Met) | CGGCCRTCCAGGGGTTCAGAAGG | Gorlin syndrome, Holoprosencephaly sequence, Holoprosencephaly 7, not specified, not provided |
| 199476091 | PTCH1 | NM_000264.3(PTCH1): c.1177G>A (p.Ala393Thr) | CAAAGCGRCAGCCATCCTGGAGG | Holoprosencephaly 7 |
| 587776628 | PTCH2 | NM_003738.4(PTCH2): c.3357+5C>T | GTGTGRTCACCTCTGGCGGCGGG, GGTGTGRTCACCTCTGGCGGCGG | |
| 587776674 | PTEN | NM_000314.6(PTEN): c.-764G>A | GCGAGRGAGATGAGAGACGGCGG, CAGGCGAGRGAGATGAGAGACGG | Cowden syndrome 1, not specified |
| 121909234 | PTEN | NM_000314.6(PTEN): c.649G>A (p.Val217Ile) | GTTTGTGRTCTGCCAGCTAAAGG | Malignant melanoma |
| 786204859 | PTEN | NM_000314.6(PTEN): c.407G>A (p.Cys136Tyr) | TATRTGCATATTTATTACATCGG | Hereditary cancer-predisposing syndrome |
| 587781255 | PTEN | NM_000314.6(PTEN): c.379G>A (p.Gly127Arg) | AAAGCTRGAAAGGGACGAACTGG | PTEN hamartoma tumor syndrome |
| 202004587 | PTEN | NM_000314.6(PTEN): c.235G>A (p.Ala79Thr) | ACCRCCAAATTTAATTGCAGAGG | PTEN hamartoma tumor syndrome, Hereditary cancer-predisposing syndrome, not specified, not provided |
| 786204856 | PTEN | NM_000314.6(PTEN): c.284C>T (p.Pro95Leu) | CCTTTTGAAGACCATAACCYACC | Hereditary cancer-predisposing syndrome |
| 121909219 | PTEN | NM_000314.6(PTEN): c.697C>T (p.Arg233Ter) | CCAATTCAGGACCCACAYGACGG | Bannayan-Riley-Ruvalcaba syndrome, PTEN hamartoma tumor syndrome, Cowden syndrome 1, Hereditary cancer-predisposing syndrome |
| 121434604 | PTH1R | NM_000316.2(PTH1R): c.310C>T (p.Arg104Ter) | CCCACTGGCAGCAGGTACYGAGG, CCACTGGCAGCAGGTACYGAGGT | Chondrodysplasia Blomstrand type |
| 397507541 | PTPN11 | NM_002834.3(PTPN11): c.1492C>T (p.Arg498Trp) | CCATCCAGATGGTGYGGTCTCAG | Noonan syndrome 1, LEOPARD syndrome 1, Rasopathy |
| 121434507 | PTPRJ | NM_002843.3(PTPRJ): c.640C>T (p.Arg214Cys) | CCCAGTTTCTGATCTCYGTGTTG, CCAGTTTCTGATCTCYGTGTTGC | Carcinoma of colon |
| 104894273 | PTS | NM_000317.2(PTS): c.74G>A (p.Arg25Gln) | AGCCACCRATTGTACAGGTAGGG, GAGCCACCRATTGTACAGGTAGG | 6-pyruvoyl-tetrahydropterin synthase deficiency |
| 104894274 | PTS | NM_000317.2(PTS): c.46C>T (p.Arg16Cys) | CCAGGCACAAGTGTCCYGCCGCA | Hyperphenylalaninemia, bh4-deficient, a, due to partial pts deficiency |
| 398123001 | PUF60 | NM_078480.2(PUF60): c.505C>T (p.His169Tyr) | CCGTCACCATGAAGYACAAGGTC | Verheij syndrome |
| 587782993 | PURA | NM_005859.4(PURA): c.556C>T (p.Gln186Ter) | CCTGGGCTCCACGCAGGGCYAGA | Neonatal hypotonia, Intellectual disability, Seizures, Delayed speech and language development, Global developmental delay, Mental retardation, autosomal dominant 31 |
| 104894371 | PUS1 | NM_001002020.2(PUS1): c.346C>T (p.Arg116Trp) | CCTTCCAGCGCTGCGCCYGGACA | Myopathy, lactic acidosis, and sideroblastic anemia 1 |
| 104894281 | PVRL1 | NM_203285.1(PVRL1): c.554G>A (p.Trp185Ter) | TCCTRGGAAACTCGGTTAAAAGG | Orofacial cleft 7, Cleft lip/palate-ectodermal dysplasia syndrome |
| 267606992 | PVRL4 | NM_030916.2(PVRL4): c.554C>T (p.Thr185Met) | CCCAGCGTGACCTGGGACAYGGA, CCAGCGTGACCTGGGACAYGGAG | Ectodermal dysplasia-syndactyly syndrome 1 |
| 587777572 | PXDN | NM_012293.2(PXDN): c.2638C>T (p.Arg880Cys) | AGCRCACGAAGAACATGCAGCGG | Sclerocornea, autosomal recessive |
| 113993984 | PYGL | NM_002863.4(PYGL): c.2017G>A (p.Glu673Lys) | GGCACCRAAGCCTCGGGGACAGG | Glycogen storage disease, type VI |
| 116987552 | PYGM | NM_005609.2(PYGM): c.148C>T (p.Arg50Ter) | CTCRTGGGGTGGCCACATTGCGG | Glycogen storage disease, type V, not provided |
| 144081869 | PYGM | NM_005609.2(PYGM): c.2056G>A (p.Gly686Arg) | CCAATGGTCAGAGCCCYGTTGAG | Glycogen storage disease, type V |
| 116315896 | PYGM | NM_005609.2(PYGM): c.645G>A (p.Lys215=) | CCTGTGTGTCCACCCAYTTGGCA | Glycogen storage disease, type V, not specified |
| 104893863 | QDPR | NM_000320.2(QDPR): c.68G>A (p.Gly23Asp) | TCTGGRTTCTCGATGCGTGCAGG | Dihydropteridine reductase deficiency |
| 587776734 | RAB39B | NM_171998.3(RAB39B): c.215+1G>A | CCCGGACTGCGCTCCCAYCTGAA, CCGGACTGCGCTCCCAYCTGAAC | Mental retardation, X-linked 72 |
| 587777167 | RAB3GAP2 | NM_012414.3(RAB3GAP2): c.1276C>T (p.Arg426Cys) | CGCRGTACCCTTAGAGACAGAGG | Martsolf syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777169 | RAB3GAP2 | NM_012414.3(RAB3GAP2): c.3637C>T (p.Arg1213Ter) | TGTCRTACAGAAATAAAATTTGG | Warburg micro syndrome 2 |
| 587777168 | RAB3GAP2 | NM_012414.3(RAB3GAP2): c.1434G>A (p.Trp478Ter) | CCCTGCTGTGTGCTYCACACTTC | Warburg micro syndrome 2 |
| 74315507 | RAC2 | NM_002872.4(RAC2): c.169G>A (p.Asp57Asn) | GTGGRACACTGCTGGGCAGGAGG, GCTGTGGRACACTGCTGGGCAGG | Neutrophil immunodeficiency syndrome |
| 121917739 | RAD51 | NM_002875.4(RAD51): c.449G>A (p.Arg150Gln) | ATTGACCRGGGTGGAGGTGAAGG | Familial cancer of breast |
| 267606997 | RAD51C | NM_058216.2(RAD51C): c.773G>A (p.Arg258His) | CTTCRTACTCGGTTATTAAATGG | Fanconi anemia, complementation group O, Hereditary cancer-predisposing syndrome |
| 104894284 | RAG1 | NM_000448.2(RAG1): c.1682G>A (p.Arg561His) | GTTCCRCTATGATTCAGCTTTGG | Histiocytic medullary reticulosis |
| 104894285 | RAG1 | NM_000448.2(RAG1): c.1681C>T (p.Arg561Cys) | CCATTGCAAAGAGGTTCYGCTAT | Histiocytic medullary reticulosis |
| 104894298 | RAG1 | NM_000448.2(RAG1): c.1519C>T (p.Arg507Trp) | CCTTTGCATGCCCTTYGGAATGC | Combined cellular and humoral immune defects with granulomas |
| 121918573 | RAG2 | NM_000536.3(RAG2): c.1433G>A (p.Cys478Tyr) | GTATTACTRCAATGAGCATGTGG | |
| 104894633 | RAI1 | NM_030665.3(RAI1): c.5423G>A (p.Ser1808Asn) | TGAGTGCARCAAGGAGGCTCCGG | Smith-Magenis syndrome |
| 527236033 | RAI1 | NM_030665.3(RAI1): c.2273G>A (p.Trp758Ter) | CCCAGGTRGGGATTGCACCCTGG | Smith-Magenis syndrome |
| 104894294 | RAPSN | NM_005055.4(RAPSN): c.490C>T (p.Arg164Cys) | CCATGCTCGAGTGCYGCGTGTGC | MYASTHENIC SYNDROME, CONGENITAL, 11, ASSOCIATED WITH ACETYLCHOLINE RECEPTOR DEFICIENCY |
| 121909127 | RAX | NM_013435.2(RAX): c.575G>A (p.Arg192Gln) | GTGGCRGCGGCAGGAGAAGCTGG | Microphthalmia, isolated 3 |
| 121908280 | RAX2 | NM_032753.3(RAX2): c.260G>A (p.Arg87Gln) | GAGCRGCTGGAGTCAGGCTCGGG, GGAGCRGCTGGAGTCAGGCTCGG | Age-related macular degeneration 6 |
| 587778838 | RB1 | NM_000321.2(RB1): c.2490-1G>A | GACARAATCTTAGTATCAATTGG | Retinoblastoma |
| 587778842 | RB1 | NM_000321.2(RB1): c.763C>T (p.Arg255Ter) | CCTCGAACACCCAGGYGAGGTCA | Retinoblastoma, not provided |
| 587778869 | RB1 | NM_000321.2(RB1): c.103C>T (p.Gln35Ter) | CCTGAGGAGGACCCAGAGYAGGA | Retinoblastoma |
| 137853293 | RB1 | NM_000321.2(RB1): c.2359C>T (p.Arg787Ter) | CCAATACCTCACATTCCTYGAAG | Retinoblastoma, not provided |
| 727503762 | RBCK1 | NM_031229.2(RBCK1): c.553C>T (p.Gln185Ter) | CCAGGAACCCGGACGGGGYAGC | Polyglucosan body myopathy 1 with or without immunodeficiency |
| 267607000 | RBM10 | NM_005676.4(RBM10): c.1235G>A (p.Trp412Ter) | GGCCCAGTRGGCCATCTCACAGG | TARP syndrome |
| 267607001 | RBM20 | NM_001134363.2(RBM20): c.1901G>A (p.Arg634Gln) | AAGGCCGCRGTCTCGTAGTCCGG | Dilated cardiomyopathy 1DD, Cardiomyopathy |
| 267607004 | RBM20 | NM_001134363.2(RBM20): c.1907G>A (p.Arg636His) | GGTCTCRTAGTCCGGTGAGCCGG | Primary dilated cardiomyopathy, Dilated cardiomyopathy 1DD, Cardiomyopathy |
| 267607003 | RBM20 | NM_001134363.2(RBM20): c.1913C>T (p.Pro638Leu) | CCGCGGTCTCGTAGTCYGGTGAG | Dilated cardiomyopathy 1DD, Cardiomyopathy |
| 146150511 | RBP3 | NM_002900.2(RBP3): c.3238G>A (p.Asp1080Asn) | CCACTGACCTCATGTYGATGATC | Retinitis pigmentosa 66 |
| 386834260 | RD3 | NM_183059.2(RD3): c.296+1G>A | CTCAGRTGAGCACTGGGATGGGG, CCTCAGRTGAGCACTGGGATGGG, TCCTCAGRTGAGCACTGGGATGG | Leber congenital amaurosis 12 |
| 387906272 | RDH12 | NM_152443.2(RDH12): c.658+1G>A | CAAGRTAAGTCTGGAGAAAGAGG | Leber congenital amaurosis 13 |
| 104894470 | RDH12 | NM_152443.2(RDH12): c.565C>T (p.Gln189Ter) | CCCTTCCACGACCTCYAGAGCGA, CCTTCCACGACCTCYAGAGCGAG | Leber congenital amaurosis 13 |
| 104894471 | RDH12 | NM_152443.2(RDH12): c.184C>T (p.Arg62Ter) | CCAGAGAGCTCGCTAGCYGAGGT | Leber congenital amaurosis 13 |
| 121434337 | RDH12 | NM_152443.2(RDH12): c.464C>T (p.Thr155Ile) | CCACTTCCTCCTCAYCTACCTGC | Leber congenital amaurosis 13 |
| 117642173 | RECQL4 | NM_004260.3(RECQL4): c.1391-1G>A | CCTCAGCCGGCGTCTYTGCAGAC | Rothmund-Thomson syndrome |
| 386833851 | RECQL4 | NM_004260.3(RECQL4): c.2476C>T (p.Arg826Ter) | CCTGCAGGGCGAAGACCTGYGAG | Rothmund-Thomson syndrome, Rapadilino syndrome, not provided |
| 760363252 | RECQL4 | NM_004260.3(RECQL4): c.1704+1G>A | CCCATGAGGCCCCAYCTTCTGC, CCATGAGGCCCCAYCTTCTGCA | Rothmund-Thomson syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853229 | RECQL4 | NM_004260.3(RECQL4): c.2269C>T (p.Gln757Ter) | CCGGGAACGGCGGCGGGTAYAGC | Rothmund-Thomson syndrome |
| 121917740 | REN | NM_000537.3(REN): c.1159C>T (p.Arg387Ter) | CCTGGGGGCCACCTTCATCYGAA | |
| 121917741 | REN | NM_000537.3(REN): c.145C>T (p.Arg49Ter) | CCGAGAAAGCCTGAAGGAAYGAG | Renal dysplasia |
| 118203913 | RFT1 | NM_052859.3(RFT1): c.199C>T (p.Arg67Cys) | CCTGGCCAGAGAGGCCTTCYGCA, CCAGAGAGGCCTTCYGCAGAGCA | Congenital disorder of glycosylation type 1N |
| 137853099 | RFX5 | NM_000449.3(RFX5): c.446G>A (p.Arg149Gln) | GCTCRAAGGCTTGGTGGCCGGGG, AGCTCRAAGGCTTGGTGGCCGGG, AAGCTCRAAGGCTTGGTGGCCGG | Bare lymphocyte syndrome type 2, complementation group E |
| 267607013 | RFX6 | NM_173560.3(RFX6): c.542G>A (p.Arg181Gln) | ACAAGGCRGCTTGGAACAAGAGG | Mitchell-Riley syndrome |
| 121918587 | RHAG | NM_000324.2(RHAG): c.836G>A (p.Gly279Glu) | CTTGCTGRAGGAGTTGCTGTGGG, CCTTGCTGRAGGAGTTGCTGTGG | |
| 387907130 | RHBDF2 | NM_024599.5(RHBDF2): c.566C>T (p.Pro189Leu) | CCCTTCCAGATTGTGGATCYGCT, CCTTCCAGATTGTGGATCYGCTG, CCAGATTGTGGATCYGCTGGCCC | Howel-Evans syndrome |
| 104893780 | RHO | NM_000539.3(RHO): c.544G>A (p.Gly182Ser) | GAGRGCCTGCAGTGCTCGTGTGG | Retinitis pigmentosa 4 |
| 527236103 | RHO | NM_000539.3(RHO): c.520G>A (p.Gly174Ser) | TCGCCRGCTGGTCCAGGTAATGG | Retinitis pigmentosa |
| 104893769 | RHO | NM_000539.3(RHO): c.50C>T (p.Thr17Met) | CCCTTCTCCAATGCGAYGGGTGT, CCTTCTCCAATGCGAYGGGTGTG | Retinitis pigmentosa 4 |
| 104893778 | RHO | NM_000539.3(RHO): c.1030C>T (p.Gln344Ter) | CCAAGACGGAGACGAGCYAGGTG | Retinitis pigmentosa 4 |
| 104893781 | RHO | NM_000539.3(RHO): c.800C>T (p.Pro267Leu) | CCTGATCTGCTGGGTGCYCTACG | Retinitis pigmentosa 4 |
| 104893794 | RHO | NM_000539.3(RHO): c.511C>T (p.Pro171Ser) | CCTGCGCCGCACCCYCACTCGCC | Retinitis pigmentosa 4 |
| 76857106 | RNASEH2A | NM_006397.2(RNASEH2A): c.109G>A (p.Gly37Ser) | GCGRGCAGGGGCCCCGTGCTGGG, GGCGRGCAGGGGCCCCGTGCTGG | Aicardi Goutieres syndrome 4 |
| 75718910 | RNASEH2A | NM_006397.2(RNASEH2A): c.704G>A (p.Arg235Gln) | TGTCCRGTTCAGCTGGCGCACGG | Aicardi Goutieres syndrome 4 |
| 397515479 | RNASEH2A | NM_006397.2(RNASEH2A): c.75C>T (p.Arg25=) | CCCGCGGTGTGCCGYAAGGAGCC | Aicardi Goutieres syndrome 4 |
| 786201014 | RNF125 | NM_017831.3(RNF125): c.336G>A (p.Met112Ile) | GTGAAATRAGGGCACATATTCGG | TENORIO SYNDROME |
| 370242930 | RNF125 | NM_017831.3(RNF125): c.520C>T (p.Arg174Cys) | CCAGTTCTGTCCACTTTGCYGTT | TENORIO SYNDROME |
| 121918162 | RNF135 | NM_032322.3(RNF135): c.857G>A (p.Arg286His) | ACCRCCCACAACCCTATCGCTGG | Macrocephaly, macrosomia, facial dysmorphism syndrome |
| 397514478 | RNF170 | NM_001160223.1(RNF170): c.595C>T (p.Arg199Cys) | CCTTTTCTGGATGTTTYGCATCA | Ataxia, sensory, autosomal dominant |
| 121918278 | ROBO3 | NM_022370.3(ROBO3): c.2317C>T (p.Gln773Ter) | CCCCCAGTGGCCCCCCAYAGGGA, CCCCAGTGGCCCCCCAYAGGGAG, CCCAGTGGCCCCCCAYAGGGAGT, CCAGTGGCCCCCCAYAGGGAGTG | Gaze palsy, familial horizontal, with progressive scoliosis |
| 121909083 | ROR2 | NM_004560.3(ROR2): c.1504C>T (p.Gln502Ter) | CCCCGGGGAGCAGACCYAGGCT, CCCGGGGAGCAGACCYAGGCTG, CCGGGGAGCAGACCYAGGCTGT | Robinow syndrome, autosomal recessive |
| 121909084 | ROR2 | NM_004560.3(ROR2): c.550C>T (p.Arg184Cys) | CCGGGGAATTGCCTGTGCAYGCT | Robinow syndrome, autosomal recessive |
| 267607016 | ROR2 | NM_004560.3(ROR2): c.1324C>T (p.Arg442Ter) | CCACACCGCAGCGGYGACAGCTG | Robinow syndrome, autosomal recessive, with brachy-syn-polydactyly |
| 104894927 | RP2 | NM_006915.2(RP2): c.358C>T (p.Arg120Ter) | CCAACAATTTCGTGTGYGAGATT | Retinitis pigmentosa 2 |
| 61751281 | RPE65 | NM_000329.2(RPE65): c.118G>A (p.Gly40Ser) | ACCRGCAGTCTCCTTCGATGTGG | Retinitis pigmentosa, not provided |
| 61752871 | RPE65 | NM_000329.2(RPE65): c.271C>T (p.Arg91Trp) | CCGCACTGATGCTTACGTAYGGG | Retinitis pigmentosa 20, not provided |
| 62638651 | RPGR | NM_000328.2(RPGR): c.703C>T (p.Pro235Ser) | CCTGGGCAATCACAGAACAYCCC | Retinitis pigmentosa 15, not provided |
| 121918204 | RPGRIP1L | NM_015272.3(RPGRIP1L): c.2050C>T (p.Gln684Ter) | CCCTTGAGGTCCACYAGGCTTAT | Joubert syndrome 7 |
| 121918591 | RPIA | NM_144563.2(RPIA): c.404C>T (p.Ala135Val) | CCCTGTCCTCCGCAGGYCCGCCA, CCTGTCCTCCGCAGGYCCGCCAG | Deficiency of ribose-5-phosphate isomerase |
| 587777527 | RPL21 | NM_000982.3(RPL21): c.95G>A (p.Arg32Gln) | TATATGCRAATCTATAAGAAAGG | Hypotrichosis 12 |
| 786200936 | RPS19 | NM_001022.3(RPS19): c.380G>A (p.Gly127Glu) | ACCTCAGGRACAAAGAGATCTGG | Diamond-Blackfan anemia 1 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894711 | RPS19 | NM_001022.3(RPS19): c.184C>T (p.Arg62Trp) | CCCCCAGCTTCCACAGCGYGGCA, CCCCAGCTTCCACAGCGYGGCAC, CCCAGCTTCCACAGCGYGGCACC, CCAGCTTCCACAGCGYGGCACCT | Diamond-Blackfan anemia 1 |
| 61762293 | RPS19 | NM_001022.3(RPS19): c.280C>T (p.Arg94Ter) | CCCAGCCACTTCAGCYGAGGCTC, CCAGCCACTTCAGCYGAGGCTCC | Diamond-Blackfan anemia 1 |
| 148622862 | RPS26 | NM_001029.3(RPS26): c.3+1G>A | AGATGRTGAGTCTTCTTGCGTGG | Diamond-Blackfan anemia 10 |
| 122454128 | RPS6KA3 | NM_004586.2(RPS6KA3): c.2065C>T (p.Gln689Ter) | CCAACTGCCACAATACYAACTAA | Coffin-Lowry syndrome |
| 397507554 | RPS7 | NM_001011.3(RPS7): c.147+1G>A | AAGRTAAGCTGGCGCTCCCTCGG | Diamond-Blackfan anemia 8 |
| 397514759 | RPSA | NM_002295.5(RPSA): c.25C>T (p.Gln9Ter) | CCCTTGATGTCCTGYAAATGAAG | Splenic hypoplasia |
| 515726181 | RRM2B | NM_015713.4(RRM2B): c.121C>T (p.Arg41Trp) | ACCRGCGAGAACTCTTTCTTAGG | RRM2B-related mitochondrial disease |
| 267607025 | RRM2B | NM_015713.4(RRM2B): c.329G>A (p.Arg110His) | GGTGGAGCRCTTTAGTCAGGAGG | Mitochondrial DNA depletion syndrome 8B (MNGIE type), RRM2B-related mitochondrial disease |
| 515726192 | RRM2B | NM_015713.4(RRM2B): c.583G>A (p.Gly195Arg) | CCTGAGAAGAAAACTCYTTCTAC | RRM2B-related mitochondrial disease |
| 515726195 | RRM2B | NM_015713.4(RRM2B): c.632G>A (p.Arg211Lys) | CCTGGCATAAGACCTYTCTTCTT | RRM2B-related mitochondrial disease |
| 200382776 | RSPH1 | NM_080860.3(RSPH1): c.727+5G>A (p.Ala244ValfsTer22) | CCACAGCCCGGGGGTGCCCYACA | Kartagener syndrome |
| 587777635 | RSPH1 | NM_080860.3(RSPH1): c.281G>A (p.Trp94Ter) | CCGCAGGTCATTTGCCYACTCTC | Primary ciliary dyskinesia 24 |
| 118204041 | RSPH4A | NM_001010892.2(RSPH4A): c.460C>T (p.Gln154Ter) | CCTTTCAACAGTCTYAGCAACCC | Ciliary dyskinesia, primary, 11 |
| 118204042 | RSPH4A | NM_001010892.2(RSPH4A): c.325C>T (p.Gln109Ter) | CCTCGCGGCACCACCTYAGTCGG | Ciliary dyskinesia, primary, 11 |
| 74315423 | RSPO4 | NM_001029871.3(RSPO4): c.218G>A (p.Cys73Tyr) | GACTRTCCCCCTGGGTACTTCGG | Anonychia |
| 387907027 | RSPO4 | NM_001029871.3(RSPO4): c.190C>T (p.Arg64Cys) | CCGCCGGGAAGGCATCYGCCAGT | Anonychia |
| 397515537 | RUNX2 | NM_001024630.3(RUNX2): c.1171C>T (p.Arg391Ter) | CCGCTTCTCCAACCCAYGAATGC | Cleidocranial dysostosis |
| 193922802 | RYR1 | NM_000540.2(RYR1): c.7048G>A (p.Ala2350Thr) | AGAACRCCAATGTGGTGGTGCGG | Malignant hyperthermia susceptibility type 1, not provided |
| 193922879 | RYR1 | NM_000540.2(RYR1): c.14524G>A (p.Val4842Met) | GACCRTGGGCCTTCTGGCGGTGG, GATGACCRTGGGCCTTCTGGCGG | Minicore myopathy with external ophthalmoplegia, Myopathy, congenital with cores, not provided |
| 794727982 | RYR1 | NM_000540.2(RYR1): c.12612G>A (p.Trp4204Ter) | GTGRGAGATGCCCCAGGTCAGGG, AGTGRGAGATGCCCCAGGTCAGG | Malignant hyperthermia susceptibility type 1, Central core disease |
| 121918594 | RYR1 | NM_000540.2(RYR1): c.7373G>A (p.Arg2458His) | CCTCCRCTCCCTTGTGCCCTTGG | Malignant hyperthermia susceptibility type 1, Central core disease, not provided |
| 118192183 | RYR1 | NM_000540.2(RYR1): c.14696G>A (p.Gly4899Glu) | AGGCATTGRGGACGAGATCGAGG | Central core disease, not provided |
| 118192125 | RYR1 | NM_000540.2(RYR1): c.8816G>A (p.Arg2939Lys) | GTTACAARGCACGCGGGTTGGGG, GGTTACAARGCACGCGGGTTGGG | Central core disease, not provided |
| 118192168 | RYR1 | NM_000540.2(RYR1): c.14545G>A (p.Val4849Ile) | GGTCRTCTACCTGTACACCGTGG | Minicore myopathy with external ophthalmoplegia, not provided |
| 193922781 | RYR1 | NM_000540.2(RYR1): c.5183C>T (p.Ser1728Phe) | CCTGCCGCAGCCGCCGCTYCATG, CCGCAGCCGCCGCTYCATGCTCT | Malignant hyperthermia susceptibility type 1, not provided |
| 148772854 | RYR1 | NM_000540.2(RYR1): c.11941C>T (p.His3981Tyr) | CCAGCAGAGCCTGGCGYACAGTC | Minicore myopathy with external ophthalmoplegia, not specified |
| 118192147 | RYR1 | NM_000540.2(RYR1): c.14659C>T (p.His4887Tyr) | CCCTCAGTGTTACCTGTTTYACA, CCTCAGTGTTACCTGTTTYACAT | Central core disease, not provided |
| 118192164 | RYR1 | NM_000540.2(RYR1): c.10579C>T (p.Pro3527Ser) | CCTGAATATGTGTGCGYCCACCG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118192173 | RYR1 | NM_000540.2(RYR1): c.325C>T (p.Arg109Trp) | CCATGCCATCCTGCTCYGGCATG | Minicore myopathy with external ophthalmoplegia, not provided |
| 118192181 | RYR1 | NM_000540.2(RYR1): c.14581C>T (p.Arg4861Cys) | CCTTCAACTTCTTCYGCAAGTTC | Central core disease, not provided |
| 587784376 | RYR1 | NM_000540.2(RYR1): c.4225C>T (p.Arg1409Ter) | CCACCCCACGCTGCCCYGACTC, CCCCCACGCTGCCCYGACTCCCT | not provided |
| 118192134 | RYR1 | NM_000540.2(RYR1): c.13910C>T (p.Thr4637Ile) | CCTGGAGGAAAGCAYAGGCTACA | Central core disease, not provided |
| 118192140 | RYR1 | NM_000540.2(RYR1): c.14126C>T (p.Thr4709Met) | CCGACTGGTGCTCAACAYGCCGT | Minicore myopathy with external ophthalmoplegia, Central core disease, not provided |
| 794728710 | RYR2 | NM_001035.2(RYR2): c.689G>A (p.Gly230Asp) | TCATTGRTGGTGATGTCCTCAGG | not provided |
| 794728805 | RYR2 | NM_001035.2(RYR2): c.14465G>A (p.Arg4822His) | TTCRTGCTGGAGGAGGGATCGGG, GTTCRTGCTGGAGGAGGGATCGG | not provided |
| 794728754 | RYR2 | NM_001035.2(RYR2): c.7160C>T (p.Ala2387Val) | CCACATGGGGAACGYGATCATGA | not provided |
| 121918600 | RYR2 | NM_001035.2(RYR2): c.13489C>T (p.Arg4497Cys) | CCCTCAGAACTATTTTGCTYGCA, CCTCAGAACTATTTTGCTYGCAA | Catecholaminergic polymorphic ventricular tachycardia |
| 764698152 | RYR2 | NM_001035.2(RYR2): c.1240C>T (p.Arg414Cys) | CCCAGCATGAAGAATCAYGCACA, CCAGCATGAAGAATCAYGCACAG | not provided |
| 79681911 | SAA1 | NM_000331.4(SAA1): c.269G>A (p.Gly90Asp) | CCATGRTGCGGAGGACTCGCTGG | |
| 281865119 | SACS | NM_014363.5(SACS): c.10907G>A (p.Arg3636Gln) | GAACRAATGGATTTGTTATCTGG | Spastic ataxia Charlevoix-Saguenay type |
| 281865120 | SACS | NM_014363.5(SACS): c.12160C>T (p.Gln4054Ter) | CCTGCTTTGAAAAGCTTYAAACA | Spastic ataxia Charlevoix-Saguenay type |
| 587777209 | SAG | NM_000541.4(SAG): c.523C>T (p.Arg175Ter) | CCCACAGGAGCTCCGTGYGATTA, CCACAGGAGCTCCGTGYGATTAC | Oguchi disease |
| 104894538 | SALL1 | NM_002968.2(SALL1): c.967C>T (p.Gln323Ter) | CCCCCAATCCAGCTACCTYAGAG, CCCCAATCCAGCTACCTYAGAGC, CCAATCCAGCTACCTYAGAGCA, CCAATCCAGCTACCTYAGAGCAG | Townes-Brocks-branchiootorenal-like syndrome |
| 515726145 | SAMHD1 | NM_015474.3(SAMHD1): c.434G>A (p.Arg145Gln) | CCCAGCTGTTTGATGTATYGAAG, CCAGCTGTTTGATGTATYGAAGA | Aicardi Goutieres syndrome 5 |
| 267607027 | SAMHD1 | NM_015474.3(SAMHD1): c.490C>T (p.Arg164Ter) | CCAGGAGCTTCACACAATYGATT | Aicardi Goutieres syndrome 5 |
| 121434517 | SAMHD1 | NM_015474.3(SAMHD1): c.433G>A (p.Arg145Ter) | CCTCAATTTCAACGTCTTYGATA | Aicardi Goutieres syndrome 5 |
| 121434519 | SAMHD1 | NM_015474.3(SAMHD1): c.1642C>T (p.Gln548Ter) | CCAGAGAAATTTGCAGAGYAGCT | Aicardi Goutieres syndrome 5 |
| 200053119 | SCARB2 | NM_005506.3(SCARB2): c.361C>T (p.Arg121Ter) | TTGGTCTCRTTCAAAAACATAGG | not provided |
| 387907086 | SCARF2 | NM_153334.6(SCARF2): c.773G>A (p.Cys258Tyr) | GGCACGTRTGCCTGCGAGCCGGG, CGGCACGTRTGCCTGCGAGCCGG | Marden Walker like syndrome |
| 138607170 | SCN11A | NM_001287223.1(SCN11A): c.673C>T (p.Arg225Cys) | AACACACRGAAGGTACGCAGGGG, GAACACACRGAAGGTACGCAGGG | Episodic pain syndrome, familial, 3 |
| 794726716 | SCN1A | NM_001165963.1(SCN1A): c.2876G>A (p.Cys959Tyr) | TGGGACTRTATGGAGGTTGCTGG | Severe myoclonic epilepsy in infancy |
| 794726824 | SCN1A | NM_001165963.1(SCN1A): c.965-1G>A | AACARGATATCATTATTTCCTGG | Severe myoclonic epilepsy in infancy, not provided |
| 794726828 | SCN1A | NM_001165963.1(SCN1A): c.2929G>A (p.Val977Met) | CATGRTGATTGGAAACCTAGTGG | Severe myoclonic epilepsy in infancy |
| 796052972 | SCN1A | NM_001165963.1(SCN1A): c.1153G>A (p.Glu385Lys) | CTGGRAAAATCTTTATCAACTGG | not provided |
| 121917957 | SCN1A | NM_006920.4(SCN1A): c.1130G>A (p.Arg377Gln) | CTTGTTTCRACTAATGACTCAGG | Severe myoclonic epilepsy in infancy, Generalized epilepsy with febrile seizures plus, type 1, not provided |
| 121917971 | SCN1A | NM_006920.4(SCN1A): c.2804G>A (p.Arg935His) | TCCVCGTGCTGTGTGGGAGTGG, TGTGTTCCVCGTGCTGTGTGGGG | Severe myoclonic epilepsy in infancy |
| 398123588 | SCN1A | NM_006920.4(SCN1A): c.2543G>A (p.Arg848His) | TGTTCTCCRTTCATTTCGATTGG | Severe myoclonic epilepsy in infancy, Generalized epilepsy with febrile seizures plus, type 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 763400390 | SCN1A | NM_001165963.1(SCN1A): c.2177-1G>T | CCTGGATTCTTCAAGTTHTAGAT | not provided |
| 794726736 | SCN1A | NM_001165963.1(SCN1A): c.1738C>T (p.Arg580Ter) | CCTTTTCAGCTTTAGAGGGYGAG | Severe myoclonic epilepsy in infancy |
| 794726766 | SCN1A | NM_001165963.1(SCN1A): c.2303C>T (p.Pro768Leu) | CCTGGTTGTGATGGACCYATTTG | Severe myoclonic epilepsy in infancy |
| 794726778 | SCN1A | NM_001165963.1(SCN1A): c.1834C>T (p.Arg612Ter) | CCTTGTTTGTGCCCYGACGACAC | Severe myoclonic epilepsy in infancy |
| 796052955 | SCN1A | NM_001165963.1(SCN1A): c.311C>T (p.Ala104Val) | CCATCTTCCGGTTCAGTGYCACC | not provided |
| 796053089 | SCN1A | NM_001165963.1(SCN1A): c.314C>T (p.Thr105Ile) | CCGGTTCAGTGCCAYCTCTGCCC | not provided |
| 121917984 | SCN1A | NM_006920.4(SCN1A): c.677C>T (p.Thr226Met) | CCGAGCATTGAAGABGATTTCAG | Severe myoclonic epilepsy in infancy, not provided |
| 794726730 | SCN1A | NM_001165963.1(SCN1A): c.2134C>T (p.Arg712Ter) | CCTTCCCAAAGGCAAYGAGCAAT | Severe myoclonic epilepsy in infancy, Generalized epilepsy with febrile seizures plus, type 2, not provided |
| 794726838 | SCN1A | NM_001165963.1(SCN1A): c.1970C>T (p.Pro657Leu) | CCTTGGTTGGTGGACYTTCAGTT | Severe myoclonic epilepsy in infancy |
| 786205835 | SCN1B | NM_001037.4(SCN1B): c.449-1G>A | CCCTGCARCCAACAGAGACATGG | not provided |
| 786205837 | SCN1B | NM_001037.4(SCN1B): c.73G>A (p.Asp25Asn) | GGAGGTGRACTCGGAGACCGAGG | not provided |
| 16969925 | SCN1B | NM_001037.4(SCN1B): c.254G>A (p.Arg85His) | TGAGCRCTTCGAGGGCCGCGTGG | Atrial fibrillation, familial, 13 |
| 794727152 | SCN2A | NM_021007.2(SCN2A): c.2558G>A (p.Arg853Gln) | TTCCRGCTGGTAAATTAACTGGG, ATTCCRGCTGGTAAATTAACTGG | Early infantile epileptic encephalopathy 11, not provided |
| 121917751 | SCN2A | NM_021007.2(SCN2A): c.2674G>A (p.Val892Ile) | CATCRTCTTCATTTTTGCTGTGG | Benign familial neonatal-infantile seizures, not provided |
| 121917753 | SCN2A | NM_021007.2(SCN2A): c.3956G>A (p.Arg1319Gln) | GTCCCRGTTTGAAGGAATGAGGG, TGTCCCRGTTTGAAGGAATGAGG | Benign familial neonatal-infantile seizures, not provided |
| 796053197 | SCN2A | NM_021007.2(SCN2A): c.2809C>T (p.Arg937Cys) | CCTTCCTGATCGTGTTCYGCGTG | not provided |
| 121917749 | SCN2A | NM_001040142.1(SCN2A): c.3988C>T (p.Leu1330Phe) | CCAGGTTGTTGTAAATGCTYTTT | Benign familial neonatal-infantile seizures |
| 587777558 | SCN3B | NM_018400.3(SCN3B): c.17G>A (p.Arg6Lys) | CCAGGGGAAACAATYTATTGAAG | Atrial fibrillation, familial, 16 |
| 121908545 | SCN4A | NM_000334.4(SCN4A): c.4343G>A (p.Arg1448His) | TCCRTGTGATCCGCCTGGCGCGG, GCTGTTCCRTGTGATCCGCCTGG | Paramyotonia congenita of von Eulenburg |
| 121908557 | SCN4A | NM_000334.4(SCN4A): c.2024G>A (p.Arg675Gln) | GCAGCTGCRGGTCTTCAAGCTGG | Normokalemic periodic paralysis, potassium-sensitive |
| 80338789 | SCN4A | NM_000334.4(SCN4A): c.3395G>A (p.Arg1132Gln) | TGCRGGCCCTGCGTCCCCTGAGG | Hypokalemic periodic paralysis 1, Hypokalemic periodic paralysis, type 2 |
| 80338784 | SCN4A | NM_000334.4(SCN4A): c.2006G>A (p.Arg669His) | TGTGCTACRCTCCTTCCGTCTGG | Hypokalemic periodic paralysis 1, Hypokalemic periodicparalysis, type 2 |
| 527236148 | SCN4A | NM_000334.4(SCN4A): c.664C>T (p.Arg222Trp) | CAGCACCCRGAAGGTCCTCAGGG | Hypokalemic periodic paralysis, type 2 |
| 121908555 | SCN4A | NM_000334.4(SCN4A): c.3472C>T (p.Pro1158Ser) | CCCTCCTAGGCGCCATCYCCTCC, CCTCCTAGGCGCCATCYCCTCCA | Hypokalemic periodic paralysis, type 2 |
| 794728858 | SCN5A | NM_198056.2(SCN5A): c.1891-1G>A | CACTCARCCACGCCATCGGAGG | not provided |
| 794728926 | SCN5A | NM_198056.2(SCN5A): c.1122G>A (p.Trp374Ter) | CTGRGAGCGCCTCTATCAGCAGG | not provided |
| 794728933 | SCN5A | NM_198056.2(SCN5A): c.3840+5G>A | CGTGARTGTGGGCACCCGAAGGG, ACGTGARTGTGGGCACCCGAAGG | not provided |
| 199473047 | SCN5A | NM_000335.4(SCN5A): c.128G>A (p.Arg43Gln) | GAGCCRAGAGGGGCTGCCCGAGG | Congenital long QT syndrome |
| 199473048 | SCN5A | NM_198056.2(SCN5A): c.142G>A (p.Glu48Lys) | TGCCCRAGGAGGAGGCTCCCCGG | Congenital long QT syndrome, not provided |
| 199473084 | SCN5A | NM_000335.4(SCN5A): c.865G>A (p.Gly289Ser) | CAACRGCACCAACGGCTCCGTGG | Long QT syndrome, Congenital long QT syndrome |
| 199473085 | SCN5A | NM_198056.2(SCN5A): c.874G>A (p.Gly292Ser) | AACRGCTCCGTGGAGGCCGACGG | Brugada syndrome, not provided |
| 199473086 | SCN5A | NM_000335.4(SCN5A): c.880G>A (p.Val294Met) | CTCCRTGGAGGCCGACGGCTTGG | Brugada syndrome |
| 199473088 | SCN5A | NM_000335.4(SCN5A): c.898G>A (p.Val300Ile) | CGGCTTGRTCTGGGAATCCCTGG | Brugada syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473101 | SCN5A | NM_198056.2(SCN5A): c.1127G>A (p.Arg376His) | CTGGGAGCRCCTCTATCAGCAGG | Brugada syndrome, not provided |
| 199473110 | SCN5A | NM_000335.4(SCN5A): c.1237G>A (p.Ala413Thr) | CGTGGTCRCAATGGCCTATGAGG | Congenital long QT syndrome |
| 199473138 | SCN5A | NM_000335.4(SCN5A): c.1960G>A (p.Glu654Lys) | GCTTCRAGGAGCCAGGAGCACGG | Congenital long QT syndrome |
| 199473159 | SCN5A | NM_000335.4(SCN5A): c.2365G>A (p.Val789Ile) | CATCRTCATCCTTAGCCTCATGG | Brugada syndrome |
| 199473172 | SCN5A | NM_000335.4(SCN5A): c.2678G>A (p.Arg893His) | TCCDCATCCTCTGTGGAGAGTGG | Brugada syndrome |
| 199473195 | SCN5A | NM_000335.4(SCN5A): c.3337G>A (p.Asp1113Asn) | AGGCCRACTGGCGGCAGCAGTGG | Congenital long QT syndrome |
| 199473206 | SCN5A | NM_198056.2(SCN5A): c.3695G>A (p.Arg1232Gln) | AGAGGAGCRGAAGACCATCAAGG | Brugada syndrome, not provided |
| 199473233 | SCN5A | NM_198056.2(SCN5A): c.4057G>A (p.Val1353Met) | TGGGCRTGAACCTCTTTGCGGGG, ATGGGCRTGAACCTCTTTGCGGG, CATGGGCRTGAACCTCTTTGCGG | Brugada syndrome, not provided |
| 199473294 | SCN5A | NM_198056.2(SCN5A): c.5038G>A (p.Ala1680Thr) | CTTCRCTTATGTCAAGTGGGAGG, CAACTTCRCTTATGTCAAGTGG, CCAACTTCRCTTATGTCAAGTGG | Brugada syndrome, Sudden cardiac death, not provided |
| 199473341 | SCN5A | NM_000335.4(SCN5A): c.3832G>A (p.Val1278Ile) | CTCATCRTAGACGTGAGTGTGGG, CCTCATCRTAGACGTGAGTGTGG | Primary dilated cardiomyopathy, Dilated cardiomyopathy, not provided |
| 199473552 | SCN5A | NM_000335.4(SCN5A): c.103G>A (p.Gly35Ser) | CCGCRGCTCAACCACCTTGCAGG | Brugada syndrome |
| 199473572 | SCN5A | NM_000335.4(SCN5A): c.1384G>A (p.Glu462Lys) | CTCCTTGRAGATGTCCCCTTTGG | Long QT syndrome, Congenital long QT syndrome, not provided |
| 199473582 | SCN5A | NM_000335.4(SCN5A): c.2236G>A (p.Glu746Lys) | TTCRAGGAGATGCTGCAGGTCGG, TGAATTCRAGGAGATGCTGCAGG | Brugada syndrome |
| 199473584 | SCN5A | NM_198056.2(SCN5A): c.2441G>A (p.Arg814Gln) | CCAGCTGCRGGTCTTCAAGCTGG | Brugada syndrome |
| 199473595 | SCN5A | NM_000335.4(SCN5A): c.3553G>A (p.Ala1185Thr) | CACAGRCCCCAGGGAAGGTCTGG | Congenital long QT syndrome, not specified |
| 199473605 | SCN5A | NM_198056.2(SCN5A): c.4018G>A (p.Val1340Ile) | TCCTCRTCTGCCTCATCTTCTGG | Brugada syndrome, not provided |
| 199473637 | SCN5A | NM_000335.4(SCN5A): c.5800G>A (p.Gly1934Ser) | GGGCAGCRGCCTCTCCGAAGAGG | Brugada syndrome |
| 778522112 | SCN5A | NM_198056.2(SCN5A): c.1880C>T (p.Pro627Leu) | GGCRGGTGCTCTAGCATCACAGG | not provided |
| 137854601 | SCN5A | NM_198056.2(SCN5A): c.5350G>A (p.Glu1784Lys) | GAGCACCRAGCCCCTGAGTGAGG | Long QT syndrome 3, Brugada syndrome 1, Sinus node disease, Congenital long QT syndrome, not provided |
| 187531872 | SCN5A | NM_198056.2(SCN5A): c.998+5G>A | CCCGGGGTGGTAGGTGCCAYATA, CCGGGGTGGTAGGTGCCAYATAC | Arrhythmogenic right ventricular cardiomyopathy, not specified, not provided |
| 794728877 | SCN5A | NM_198056.2(SCN5A): c.3994C>T (p.Pro1332Ser) | CCCTGGTGGGCGCCATCYCGTCC, CCTGGTGGGCGCCATCYCGTCCA | not provided |
| 199473072 | SCN5A | NM_000335.4(SCN5A): c.673C>T (p.Arg225Trp) | CCTTCCGAGTCCTCYGGGCCCTG | Congenital long QT syndrome, Cardiac conduction defect, nonspecific, not provided |
| 199473097 | SCN5A | NM_198056.2(SCN5A): c.1099C>T (p.Arg367Cys) | CCTTTCTTGCACTCTTCYGCCTG | Congenital long QT syndrome, not provided |
| 199473133 | SCN5A | NM_000335.4(SCN5A): c.1855C>T (p.Leu619Phe) | CCCCAGGAAGCCACCTCYTCCGC, CCCAGGAAGCCACCTCYTCCGCC, CCAGGAAGCCACCTCYTCCGCCC | Brugada syndrome, Long QT syndrome |
| 199473134 | SCN5A | NM_000335.4(SCN5A): c.1895C>T (p.Thr632Met) | CCTGATTGCACTCAGACCAYGCC | Brugada syndrome |
| 199473139 | SCN5A | NM_000335.4(SCN5A): c.1981C>T (p.Arg661Trp) | CCAGGAGCACGGCAGYGGGCCCT | Brugada syndrome |
| 199473171 | SCN5A | NM_198056.2(SCN5A): c.2677C>T (p.Arg893Cys) | CCTTCCTCATCATCTTCYGCATC | Brugada syndrome, not provided |
| 199473192 | SCN5A | NM_000335.4(SCN5A): c.3296C>T (p.Ala1099Val) | CCTGGAGCCAGGTGTCAGYGACT | Long QT syndrome, Congenital long QT syndrome, not provided |
| 199473194 | SCN5A | NM_000335.4(SCN5A): c.3335C>T (p.Ala1112Val) | CCAGTGCATCTCAGGYCGACTGG | Brugada syndrome |
| 199473197 | SCN5A | NM_198056.2(SCN5A): c.3392C>T (p.Thr1131Ile) | CCACACCCCTGTCCATAGAYCCC, CCCCTGTCCATAGAYCCCAGAGG | Atrial fibrillation, not provided |
| 199473200 | SCN5A | NM_000335.4(SCN5A): c.3520C>T (p.Arg1174Cys) | CCCATAGGCTGTGTCCGGYGCTG, CCATAGGCTGTGTCCGGYGCTGT | Congenital long QT syndrome |
| 199473225 | SCN5A | NM_198056.2(SCN5A): c.3995C>T (p.Pro1332Leu) | CCCTGGTGGGCGCCATCCBGTCC, CCTGGTGGGCGCCATCCBGTCCA | Brugada syndrome, not provided |
| 199473288 | SCN5A | NM_198056.2(SCN5A): c.4934C>T (p.Thr1645Met) | CCAAGGGGATCCGCAYGCTGCTC | Congenital long QT syndrome, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473561 | SCN5A | NM_000335.4(SCN5A): c.677C>T (p.Ala226Val) | CCTTCCGAGTCCTCCGGGYCCTG, CCGAGTCCTCCGGGYCCTGAAAA | Brugada syndrome |
| 199473576 | SCN5A | NM_198056.2(SCN5A): c.1705C>T (p.Arg569Trp) | CCCTGGCCCCTGCGCBGGACCAG, CCTGGCCCCTGCGCBGGACCAGT | Congenital long QT syndrome, not provided |
| 199473577 | SCN5A | NM_000335.4(SCN5A): c.1858C>T (p.Arg620Cys) | CCCAGGAAGCCACCTCCTCYGCC, CCAGGAAGCCACCTCCTCYGCCC | Brugada syndrome |
| 199473580 | SCN5A | NM_000335.4(SCN5A): c.2065C>T (p.Arg689Cys) | CCACCATGCTGGAACYGTCTCGC | Congenital long QT syndrome |
| 199473603 | SCN5A | NM_000335.4(SCN5A): c.3908C>T (p.Thr1303Met) | CCCATCAAGTCACTGCGGAYGCT, CCATCAAGTCACTGCGGAYGCTG | Long QT syndrome, Congenital long QT syndrome, not provided |
| 199473640 | SCN5A | NM_198056.2(SCN5A): c.6034C>T (p.Arg2012Cys) | CCCTTCTCCGGACAGGGACYGTG, CCTTCTCCGGACAGGGACYGTGA | Congenital long QT syndrome, not provided |
| 192113333 | SCN5A | NM_198056.2(SCN5A): c.553G>A (p.Ala185Thr) | CCCGAAGGAAAGTGAACGYGTGC, CCGAAGGAAAGTGAACGYGTGCA | Congenital long QT syndrome, not provided |
| 769292594 | SCN5A | NM_198056.2(SCN5A): c.1706G>A (p.Arg569Gln) | CCCTGGGCACTGGTCYGGCGCAG, CCTGGGCACTGGTCYGGCGCAGG | not provided |
| 137854602 | SCN5A | NM_000335.4(SCN5A): c.4531C>T (p.Arg1511Trp) | CCCCAGAAGCCCATCCCAYGGCC, CCCAGAAGCCCATCCCAYGGCCC, CCAGAAGCCCATCCCAYGGCCCC | Brugada syndrome 1, Primary familial hypertrophic cardiomyopathy, not provided |
| 137854604 | SCN5A | NM_000335.4(SCN5A): c.5126C>T (p.Ser1709Leu) | CCAGATCACCACGTYGGCCGGCT | Brugada syndrome 1, Ventricular fibrillation, Paroxysmal familial ventricular fibrillation, not provided |
| 587777721 | SCN8A | NM_014191.3(SCN8A): c.4850G>A (p.Arg1617Gln) | CCTATTCCRAGTCATCCGATTGG | Early infantile epileptic encephalopathy 13 |
| 587780586 | SCN8A | NM_014191.3(SCN8A): c.2549G>A (p.Arg850Gln) | TTAGCTCCRAGTCTTCAAATTGG | Early infantile epileptic encephalopathy 13, not provided |
| 137852635 | SCNN1A | NM_001038.5(SCNN1A): c.1685C>T (p.Ser562Leu) | CCTGTGGTTCGGCTCCTYGGTGT | Pseudohypoaldosteronism type 1 autosomal recessive |
| 137852708 | SCNN1B | NM_000336.2(SCNN1B): c.1849C>T (p.Pro617Ser) | CCCATCCCAGGCACCCCGYCCCC, CCATCCCAGGCACCCCGYCCCCC | Pseudoprimary hyperaldosteronism |
| 5738 | SCNN1G | NM_001039.3(SCNN1G): c.589G>A (p.Glu197Lys) | ATCRAGTCCAAGCAAGTGGTGGG, CATCRAGTCCAAGCAAGTGGTGG, GCACATCRAGTCCAAGCAAGTGG | Bronchiectasis with or without elevated sweat chloride 3 |
| 137853342 | SCNN1G | NM_001039.3(SCNN1G): c.1718G>A (p.Trp573Ter) | GGAGTGGTRGGCCTGGAAACAGG | Pseudoprimary hyperaldosteronism |
| 104894630 | SCO1 | NM_004589.3(SCO1): c.521C>T (p.Pro174Leu) | CCCTGATGTCTGTCYAGAAGAAC | Cytochrome-c oxidase deficiency |
| 587777220 | SCO1 | NM_004589.3(SCO1): c.394G>A (p.Gly132Ser) | CCCCCAAGTAAAGGCTTGCYGAT, CCCCAAGTAAAGGCTTGCYGATG, CCCAAGTAAAGGCTTGCYGATGT, CCAAGTAAAGGCTTGCYGATGTG | Cytochrome-c oxidase deficiency |
| 397515337 | SDCCAG8 | NM_006642.3(SDCCAG8): c.740+356C>T | CCAACATGGTGAAACCCYGTTTC | Bardet-Biedl syndrome 16 |
| 137852768 | SDHA | NM_004168.3(SDHA): c.1664G>A (p.Gly555Glu) | CCCAGRAATGGTCTGGAACACGG | Mitochondrial complex II deficiency, Dilated cardiomyopathy 1GG |
| 9809219 | SDHA | NM_004168.3(SDHA): c.1660C>T (p.Arg554Trp) | CCTGAAGACGTTCGACYGGGGTG | Mitochondrial complex II deficiency |
| 74315371 | SDHB | NM_003000.2(SDHB): c.302G>A (p.Cys101Tyr) | TCTTRTGCAATGAACATCAATGG | Pheochromocytoma |
| 786203251 | SDHB | NM_003000.2(SDHB): c.724C>T (p.Arg242Cys) | CCCATTCTCTCTATACYGCTGCC, CCATTCTCTCTATACYGCTGCCA | Hereditary cancer-predisposing syndrome |
| 772551056 | SDHB | NM_003000.2(SDHB): c.137G>A (p.Arg46Gln) | CCTTGTCTGGGTCCCATYGATAG | Hereditary cancer-predisposing syndrome, not provided |
| 587776652 | SDHC | NM_003001.3(SDHC): c.3G>A (p.Met1Ile) | AGATRGCTGCGCTGTTGCTGAGG | Paragangliomas 3 |
| 764575966 | SDHC | NM_003001.3(SDHC): c.397C>T (p.Arg133Ter) | CCTGGAATGGGATCYGACACTTG | Hereditary cancer-predisposing syndrome |
| 34677591 | SDHD | NM_003002.3(SDHD): c.34G>A (p.Gly12Ser) | TGCRGTGCCCTAGGAGGCCGAGG | Pheochromocytoma, Paragangliomas 1, Hereditary cancer-predisposing syndrome, Carcinoid tumor of intestine, Cowden syndrome 3, not specified, not provided |
| 104894306 | SDHD | NM_003002.3(SDHD): c.64C>T (p.Arg22Ter) | CCTCAGCTCTGTTGCTTYGAACT | Pheochromocytoma, Paragangliomas 1 |
| 80338844 | SDHD | NM_003002.3(SDHD): c.242C>T (p.Pro81Leu) | CCTGGGTCTGCTTCYGGCTGCTT Pheochromocytoma | Pheochromocytoma, Hereditary Paraganglioma-Syndromes, Paragangliomas 1, Hereditary cancer-predisposing syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918222 | SEC23B | NM_032985.4(SEC23B): c.40C>T (p.Arg14Trp) | CCAGCAGAATGAAGAAYGGGATG | Congenital dyserythropoietic anemia, type II, not provided |
| 121918226 | SEC23B | NM_032985.4(SEC23B): c.649C>T (p.Arg217Ter) | CCCATGCAGCAAGCAYGACCTGC, CCATGCAGCAAGCAYGACCTGCA | Congenital dyserythropoietic anemia, type II, not provided |
| 727504145 | SEC23B | NM_032985.4(SEC23B): c.1489C>T (p.Arg497Cys) | CCCAGAGACGCATCYGCGTGACC | not provided |
| 786204845 | SEC24D | NM_014822.2(SEC24D): c.613C>T (p.Gln205Ter) | CCTCCTCCTCCAAATGCCYAGTA, CCTCCTCCAAATGCCYAGTACCA | COLE-CARPENTER SYNDROME 2 |
| 730880269 | SECISBP2 | NM_024077.4(SECISBP2): c.1212+29G>A | CATGGTRTGATATAATAAGTGGG, ACATGGTRTGATATAATAAGTGG | Thyroid hormone metabolism, abnormal |
| 121918341 | SEMA3E | NM_012431.2(SEMA3E): c.2108C>T (p.Ser703Leu) | CCTGCTCAGAGTAGCATCYGCA | CHARGE association |
| 41265017 | SEMA4A | NM_001193301.1(SEMA4A): c.2138G>A (p.Arg713Gln) | CGGGCTCRGGGCAAGGTTCAGGG, CCGGGCTCRGGGCAAGGTTCAGG | Retinitis pigmentosa 35, not specified |
| 587776597 | SEPN1 | NM_020451.2(SEPN1): 85G>A (p.5ec462=) | GCTRAGGTGAGGGGCCCGGCTGG, TCCTGCTRAGGTGAGGGGCCCGG | Eichsfeld type congenital muscular dystrophy |
| 55819880 | SERPINA1 | NM_001127701.1 (SERPINA1):c.230C>T (p.Ser77Phe) | CCAATATCTTCTTCTYCCCAGTG | Alpha-1-antitrypsin deficiency |
| 28929488 | SERPINA6 | NM_001756.3(SERPINA6): c.1165G>A (p.Asp389Asn) | TGATCTTCRACCACTTCACCTGG | Corticosteroid-binding globulin deficiency |
| 72554659 | SERPINA7 | NM_000354.5(SERPINA7): c.1051C>T (p.His351Tyr) | CCCACACAGGCTGCCYATAAGG, CCCACACAGGCTGCCYATAAGGC, CCACACAGGCTGCCYATAAGGCT | |
| 121909546 | SERPINC1 | NM_000488.3(SERPINC1): c.1306G>A (p.Ala436Thr) | CAAGRCCAACAGGCCTTTCCTGG | Antithrombin III deficiency |
| 121909562 | SERPINC1 | NM_000488.3(SERPINC1): c.481C>T (p.Arg161Ter) | CCAAACTGAACTGCYGACTCTAT | Antithrombin III deficiency |
| 121909567 | SERPINC1 | NM_000488.3(SERPINC1): c.391C>T (p.Leu131Phe) | CCTGTAATGACACCYTCCAGCAA | Antithrombin III deficiency |
| 28929469 | SERPINC1 | NM_000488.3(SERPINC1): c.166C>T (p.Arg56Cys) | CCCATGTGCATTTACYGCTCCCC, CCATGTGCATTTACYGCTCCCG | Antithrombin III deficiency |
| 6092 | SERPINE1 | NM_000602.4(SERPINE1): c.43G>A (p.Ala15Thr) | CTGRCCCTTGTCTTTGGTGAAGG | Plasminogen activator inhibitor type 1 deficiency |
| 193302873 | SERPINF1 | NM_002615.5(SERPINF1): c.1132C>T (p.Gln378Ter) | CCCCCAGCCCAGGGCTGYAGCCT, CCCCAGCCCAGGGCTGYAGCCTG, CCCAGCCCAGGGCTGYAGCCTGC, CCAGCCCAGGGCTGYAGCCTGCC | Osteogenesis imperfecta type 12, not provided |
| 121907950 | SERPING1 | NM_000062.2(SERPING1): c.1394C>T (p.Ala465Val) | CCTCCGCCATCTCTGTGGYCCGC, CCGCCATCTCTGTGGYCCGCACC | Complement component 4, partial deficiency of, due to dysfunctional c1 inhibitor |
| 28940290 | SETX | NM_015046.5(SETX): c.6638C>T (p.Pro2213Leu) | CCTAAGCAGCTCCCTCYGACAGT | Spinocerebellar ataxia autosomal recessive 1 |
| 267607044 | SETX | NM_015046.5(SETX): c.3880C>T (p.Arg1294Cys) | CCTGAAAAGGGTCCTYGTAAGG | Spinocerebellar ataxia autosomal recessive 1 |
| 121917836 | SFTPC | NM_003018.3(SFTPC): c.196G>A (p.Glu66Lys) | ACGRAGATGGTGAGAGGTGTGGG, CACGRAGATGGTGAGAGGTGTGG | Surfactant metabolism dysfunction, pulmonary, 2 |
| 143570936 | SGCA | NM_000023.2(SGCA): c.739G>A (p.Val247Met) | CAATRTGACCCTGGTGAGGAGGG, GCAATRTGACCCTGGTGAGGAGG, GGTGCAATRTGACCCTGGTGAGG | Limb-girdle muscular dystrophy, type 2D, not provided |
| 28933693 | SGCA | NM_000023.2(SGCA): c.229C>T (p.Arg77Cys) | CCTGCCCCGGTGGCTCYGCTACA | Limb-girdle muscular dystrophy, type 2D, not provided |
| 387907298 | SGCA | NM_000023.2(SGCA): c.574C>T (p.Arg192Ter) | CCCCCTTCCCATTGAGGGCYGAA, CCCCTTCCCATTGAGGGCYGAAA, CCCTTCCCATTGAGGGCYGAAAG, CCTTCCCATTGAGGGCYGAAAG | Limb-girdle muscular dystrophy, type 2D |
| 104894635 | SGSH | NM_000199.3(SGSH): c.734G>A (p.Arg245His) | TCGGCCRCATGGACCAAGGTGGG, GTCGGCCRCATGGACCAAGGTGG | Mucopolysaccharidosis, MPS-III-A, not provided |
| 104894639 | SGSH | NM_000199.3(SGSH): c.1339G>A (p.Glu447Lys) | CCCCACRAGACCCAGAACCTGG | Mucopolysaccharidosis, MPS-III-A, not provided |
| 111033627 | SH2D1A | NM_002351.4(SH2D1A): c.203C>T (p.Thr68Ile) | CCTTTTATTTTCCAGAYAGCACC | Lymphoproliferative syndrome 1, X-linked |
| 367543284 | SH3PXD2B | NM_001017995.2 (SH3PXD2B):c.401+1G>A | CAAAGARTAAGTTTGTTTGTGG, CCAAAGARTAAGTTTGTTTGTG | Frank Ter Haar syndrome, Borrone Di Rocco Crovato syndrome |
| 267607046 | SH3PXD2B | NM_001017995.2 (SH3PXD2B):c.127C>T (p.Arg43Trp) | CCACCGAGGCCATTTACYGGCGC, CCGAGGCCATTTACYGGCGCTAC | Frank Ter Haar syndrome |
| 80338922 | SH3TC2 | NM_024577.3(SH3TC2): c.1178-1G>A | CTTACARCATCCCAGCCTGAAGG | Charcot-Marie-Tooth disease, type 4C |
| 80338923 | SH3TC2 | NM_024577.3(SH3TC2): c.1586G>A (p.Arg529His) | GCCCRTCTCTGCTTCCTCCTGGG, TGCCCRTCTCTGCTTCCTCCTGG | Charcot-Marie-Tooth disease, type 4C |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338926 | SH3TC2 | NM_024577.3(SH3TC2): c.1972C>T (p.Arg658Cys) | CCTGCCCTTTGCCGAGYGCCTGC | Charcot-Marie-Tooth disease, type 4C |
| 80338937 | SH3TC2 | NM_024577.3(SH3TC2): c.3601C>T (p.Gln1201Ter) | CCTCTGTCCACCATGGCTGYAGA | Charcot-Marie-Tooth disease, type 4C |
| 387906932 | SHANK3 | NM_033517.1(SHANK3): c.3349C>T (p.Arg1117Ter) | CCCTGGCTGCCCGAGAGYGAGCT, CCTGGCTGCCCGAGAGYGAGCTC | Schizophrenia 15 |
| 104894043 | SHH | NM_000193.3(SHH): c.676G>A (p.Ala226Thr) | GTGCTGRCGGCGGACGACCAGGG, CGTGCTGRCGGCGGACGACCAGG | Holoprosencephaly 3 |
| 104894047 | SHH | NM_000193.3(SHH): c.869G>A (p.Gly290Asp) | CGGRCTCGGGGCCGCCTTCCGGG, TCGGRCTCGGGGCCGCCTTCCGG | Holoprosencephaly 3, Schizencephaly, not specified |
| 587778805 | SHH | NM_000193.3(SHH): c.664G>A (p.Asp222Asn) | CGGGRACCGCGTGCTGGCGGCGG, CCCCGGGRACCGCGTGCTGGCGG | Holoprosencephaly 3 |
| 137853341 | SHH | NM_000193.3(SHH): c.1147G>A (p.Ala383Thr) | CCGCCTGRCGCACGCGCTCCTGG | Holoprosencephaly 3 |
| 587778803 | SHH | NM_000193.3(SHH): c.625C>T (p.Gln209Ter) | CCACGGTGCACCTGGAGYAGGGC | Holoprosencephaly 3 |
| 137852556 | SHOX | NM_000451.3(SHOX): c.517C>T (p.Arg173Cys) | CCGGAGAGCCAAGTGCYGCAAAC | Leri Weill dyschondrosteosis |
| 121912616 | SI | NM_001041.3(SI): c.3218G>A (p.Gly1073Asp) | CTTTTGRCATCCAGATTCGACGG | Sucrase-isomaltase deficiency |
| 786205162 | SIK1 | NM_173354.3(SIK1): c.1897C>T (p.Gln633Ter) | CCCCTTCCACGCCCTGCAYAGA, CCCTTCCACGCCCCTGCAYAGAG, CCTTCCACGCCCCTGCAYAGAGC | EPILEPTIC ENCEPHALOPATHY, EARLY INFANTILE, 30 |
| 119456965 | SIL1 | NM_001037633.1(SIL1): c.331C>T (p.Arg111Ter) | CCAATATGAGGACAAGTTCYGAA | Marinesco-Sj\xc3V(b6gren syndrome |
| 119456966 | SIL1 | NM_001037633.1(SIL1): c.1312C>T (p.Gln438Ter) | CCAGCCTGGAGCTGYAGGATGGT | Marinesco-Sj\xc3V(b6gren syndrome, not provided |
| 80356459 | SIX1 | NM_005982.3(SIX1): c.328C>T (p.Arg110Trp) | CCGTGGGCAAATATYGGGTGCGC | Branchiootic syndrome 3 |
| 121917881 | SIX3 | NM_005413.3(SIX3): c.206G>A (p.Gly69Asp) | CGGCGRCTCCAGGGCCCCCCCGG | Holoprosencephaly 2 |
| 80356462 | SIX5 | NM_175875.4(SIX5): c.886G>A (p.Ala296Thr) | TCCRCCGAGGCCGCTGCCCAGGG, GTCRCCGAGGCCGCTGCCCAGG | Branchiootorenal syndrome 2 |
| 121918366 | SLC11A2 | NM_001174125.1(SLC11A2): c.1333C>T (p.Arg445Cys) | CCCGAGTGGTTCTGACTYGCTCT, CCGAGTGGTTCTGACTYGCTCTA | Hypochromic microcytic anemia with iron overload |
| 267607051 | SLC12A3 | NM_000339.2(SLC12A3): c.2612G>A (p.Arg871His) | AAGATCCRTGTGTTCGTAGGCGG | Familial hypokalemia-hypomagnesemia |
| 28936388 | SLC12A3 | NM_000339.2(SLC12A3): c.625C>T (p.Arg209Trp) | CCTACTTCCTCATCTCCYGGAGT | Familial hypokalemia-hypomagnesemia |
| 371443644 | SLC12A3 | NM_000339.2(SLC12A3): c.179C>T (p.Thr60Met) | CCTTTGGCTACAACAYGATCGAT | Familial hypokalemia-hypomagnesemia |
| 606231229 | SLC12A6 | NM_005135.2(SLC12A6): c.3247C>T (p.Arg1083Ter) | CCGAGGGACTAGAGYGAGTCCTA | Andermann syndrome |
| 121908428 | SLC12A6 | NM_133647.1(SLC12A6): c.2023C>T (p.Arg675Ter) | CCCAACTGGAGACCCYGATTCCG, CCAACTGGAGACCCYGATTCCGC | Andermann syndrome |
| 587777577 | SLC13A5 | NM_177550.4(SLC13A5): c.680C>T (p.Thr227Met) | TCCCRTCCCGGTCAGGGTGGCGG, GGGTCCCRTCCCGGTCAGGGTGG | Epileptic encephalopathy, early infantile, 25 |
| 121909386 | SLC16A12 | NM_213606.3(SLC16A12): c.733C>T (p.Gln245Ter) | CCATGTGTGTAGAACTYAGAAAG | Cataract, juvenile, with microcornea and glucosuria |
| 587784382 | SLC16A2 | NM_006517.4(SLC16A2): c.916C>T (p.Gln306Ter) | CCAGCGCTTTCTGGCTYAGCTCA | Allan-Herndon-Dudley syndrome |
| 587784386 | SLC16A2 | NM_006517.4(SLC16A2): c.277C>T (p.Gln93Ter) | CCGCGCGCGGCTTCYAGCCTCCC | Allan-Herndon-Dudley syndrome |
| 80338794 | SLC17A5 | NM_012434.4(SLC17A5): c.115C>T (p.Arg39Cys) | CCAGTGTGCTGCTCTGCTYGTTA | Salla disease |
| 606231251 | SLC17A9 | NM_022082.3(SLC17A9): c.932G>A (p.Arg311Gln) | GTGCRGAAGCTCATGCAGGTAGG, CACGGTGCRGAAGCTCATGCAGG | Porokeratosis 8, disseminated superficial actinic type |
| 548728088 | SLC17A9 | NM_022082.3(SLC17A9): c.25C>T (p.Arg9Cys) | CCACCCCAGACGAGGCCYGCAG, CCCCAGACGAGGCCYGCAGGGA, CCCCAGACGAGGCCYGCAGGGAC | Porokeratosis 8, disseminated superficial actinic type |
| 121908540 | SLC19A2 | NM_006996.2(SLC19A2): c.152C>T (p.Pro51Leu) | CCTCAGGCCGTCCGAGCYCTTCC | Megaloblastic anemia, thiamine-responsive, with diabetes mellitus and sensorineural deafness |
| 587777696 | SLC1A1 | NM_004170.5(SLC1A1): c.1333C>T (p.Arg445Trp) | CCCGTCTCTCCCCAGGGACYGGT, CCGTCTCTCCCCAGGGACYGGTT | Dicarboxylic aminoaciduria |
| 121907892 | SLC22A12 | NM_144585.3(SLC22A12): c.774G>A (p.Trp258Ter) | CTGRACACTGCTGCAGCTGGTGG, GGACTGRACACTGCTGCAGCTGG | Familial renal hypouricemia |
| 121907896 | SLC22A12 | NM_144585.3(SLC22A12): c.269G>A (p.Arg90His) | GCCRCTTCCGCCAGCCACAGTGG | Familial renal hypouricemia |
| 78838117 | SLC22A18 | NM_002555.5 (SLC22A18): c.257G>A (p.Arg86His) | AGACCAGCRCGGGGCGCGGGCGG | |
| 121909071 | SLC22A18 | NM_183233.2(SLC22A18): c.698C>T (p.Ser233Phe) | CCTGAAGGCCATCGCCYCCTGC | Lung cancer |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908891 | SLC22A5 | NM_003060.3(SLC22A5): c.1196G>A (p.Arg399Gln) | TTTGCCCCRGCGCTATTCCATGG | Renal carnitine transport defect |
| 386134210 | SLC22A5 | NM_003060.3(SLC22A5): c.845G>A (p.Arg282Gln) | CCCCRATGGCTCATCTCTCAGGG, CCCCCRATGGCTCATCTCTCAGG | Renal carnitine transport defect |
| 386134199 | SLC22A5 | NM_003060.3(SLC22A5): c.641C>T (p.Ala214Val) | CCAACTATGTGGCAGYATTTGTC | Renal carnitine transport defect, not provided |
| 368647424 | SLC25A1 | NM_005984.4(SLC25A1): c.389G>A (p.Gly130Asp) | CCTCGGCCACGCCAGCGYCCAGG | Combined d-2- and 1-2-hydroxyglutaric aciduria |
| 121908532 | SLC25A13 | NM_014251.2(SLC25A13): c.1763G>A (p.Arg588Gln) | TTTCRATCCTCACCCCAGTTTGG | Citrullinemia type II |
| 80338715 | SLC25A13 | NM_014251.2(SLC25A13): c.15G>A (p.Lys5=) | CCAARGTAACCGCGGGCCCGAGG | Neonatal intrahepatic cholestasis caused by citrin deficiency |
| 202247804 | SLC25A15 | NM_014252.3(SLC25A15): c.569G>A (p.Gly190Asp) | TCGGTGRCTATGAACTGAGCCGG | Hyperornithinemia-hyperammonemia-homocitrullinuria syndrome |
| 202247805 | SLC25A15 | NM_014252.3(SLC25A15): c.658G>A (p.Gly220Arg) | GAGTTGGTRGGATTTGCCTCTGG | Hyperornithinemia-hyperammonemia-homocitrullinuria syndrome |
| 104894431 | SLC25A15 | NM_014252.3(SLC25A15): c.824G>A (p.Arg275Gln) | ATTCRAGCATTCCCTGCCAATGG | Hyperornithinemia-hyperammonemia-homocitrullinuria syndrome |
| 202247809 | SLC25A15 | NM_014252.3(SLC25A15): c.847C>T (p.Leu283Phe) | CCCTGCCAATGGAGCAYTCTTTT, CCTGCCAATGGAGCAYTCTTTTT | Hyperornithinemia-hyperammonemia-homocitrullinuria syndrome |
| 151340616 | SLC25A20 | NM_000387.5(SLC25A20): c.496C>T (p.Arg166Ter) | CCAGGAGTTTGGGATCYGAGGCA | Carnitine acylcarnitine translocase deficiency |
| 104894375 | SLC25A3 | NM_005888.3(SLC25A3): c.215G>A (p.Gly72Glu) | CTTGGAGRAATTATTAGCTGTGG | Mitochondrial phosphate carrier deficiency |
| 398122942 | SLC25A4 | NM_001151.3(SLC25A4): c.111+1G>A | TGCTGCAGRTGAGGACCGCGCGG | Mitochondrial DNA depletion syndrome 12 (cardiomyopathic type) |
| 111033309 | SLC26A4 | NM_000441.1(SLC26A4): c.2015G>A (p.Gly672Glu) | TGTTGRAGTGAGATCACTGCGGG, TTGTTGRAGTGAGATCACTGCGG | Pendred syndrome, Enlarged vestibular aqueduct syndrome |
| 111033220 | SLC26A4 | NM_000441.1(SLC26A4): c.1229C>T (p.Thr410Met) | CCACTGCTCTTTCCCGCAYGGCC | Pendred syndrome, Enlarged vestibular aqueduct syndrome |
| 142724470 | SLC26A8 | NM_052961.3(SLC26A8): c.2434G>A (p.Glu812Lys) | CCCGTATCACTGTCTYGGATTCA, CCGTATCACTGTCTYGGATTCAT | Spermatogenic failure 3 |
| 137853132 | SLC27A4 | NM_005094.3(SLC27A4): c.274G>A (p.Ala92Thr) | AAGACGRCCCTGATCTTCGAGGG, CAAGACGRCCCTGATCTTCGAGG | Ichthyosis prematurity syndrome |
| 121912583 | SLC29A3 | NM_018344.5(SLC29A3): c.1279G>A (p.Gly427Ser) | CAACRGCTACCTCAGCACCCTGG | Histiocytosis-lymphadenopathy plus syndrome |
| 387907066 | SLC29A3 | NM_018344.5(SLC29A3): c.1088G>A (p.Arg363Gln) | GTGGCCRGCAGCTCACCGCCTGG | Histiocytosis-lymphadenopathy plus syndrome |
| 587780462 | SLC29A3 | NM_018344.5(SLC29A3): c.1228C>T (p.Gln410Ter) | CCTGAAGACTGTGGTCTTCYAGT | Histiocytosis-lymphadenopathy plus syndrome |
| 80359814 | SLC2A1 | NM_006516.2(SLC2A1): c.272G>A (p.Gly91Asp) | CTTTGRCCGGTAAGTAGGAGAGG | Glucose transporter type 1 deficiency syndrome |
| 80359841 | SLC2A1 | NM_006516.2(SLC2A1): c.18+1G>A | AAGRTGAGTCGCGCGCCCGCGGG, CAAGRTGAGTCGCGCGCCCGCGG | not provided |
| 121909739 | SLC2A1 | NM_006516.2(SLC2A1): c.940G>A (p.Gly314Ser) | TGGCTCCRGTATCGTCAACACGG | GLUT1 deficiency syndrome 2, Glucose transporter type 1 deficiency syndrome, Epilepsy, idiopathic generalized, susceptibility to, 12, not provided |
| 796053248 | SLC2A1 | NM_006516.2(SLC2A1): c.667C>T (p.Arg223Trp) | CCGCAACGAGGAGAACYGGGCCA | not provided |
| 796053253 | SLC2A1 | NM_006516.2(SLC2A1): c.971C>T (p.Ser324Leu) | CCTTCACTGTCGTGTYGGTGAGT | not provided |
| 387907313 | SLC2A1 | NM_006516.2(SLC2A1): c.694C>T (p.Arg232Cys) | CCCAGTGCTAAAGAAGCTGYGCG, CCAGTGCTAAAGAAGCTGYGCGG | Epilepsy, idiopathic generalized, susceptibility to, 12, not provided |
| 121909743 | SLC2A2 | NM_000340.1(SLC2A2): c.901C>T (p.Arg301Ter) | CCAATTCCAGCTACYGACAGCCT | Fanconi-Bickel syndrome |
| 281860290 | SLC30A10 | NM_018713.2(SLC30A10): c.922C>T (p.Gln308Ter) | CCGCTGCCATTCTGCTAYAGATG | Hypermanganesemia with dystonia, polycythemia and cirrhosis |
| 121918237 | SLC34A3 | NM_001177317.1(SLC34A3): c.586G>A (p.Gly196Arg) | CGGTGCACRGGATCTTCAACTGG | Autosomal recessive hypophosphatemic bone disease |
| 587777436 | SLC35A2 | NM_001042498.2(SLC35A2): c.638C>T (p.Ser213Phe) | GAAGCCGRAGGAGAGACAGGAGG | CONGENITAL DISORDER OF GLYCOSYLATION, TYPE IIm |
| 587776962 | SLC35A2 | NM_001042498.2(SLC35A2): c.3G>A (p.Met1Ile) | CCAGCCCCAACCGCTGCYATGTT | CONGENITAL DISORDER OF GLYCOSYLATION, TYPE IIm |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28939087 | SLC35C1 | NM_018389.4(SLC35C1): c.439C>T (p.Arg147Cys) | CCTTCTACAATGTGGGCYGCTCA | Congenital disorder of glycosylation type 2C |
| 137853111 | SLC35D1 | NM_015139.2(SLC35D1): c.932G>A (p.Trp311Ter) | TTCACGTRGACAAACTTCATTGG | Schneckenbecken dysplasia |
| 80356492 | SLC37A4 | NM_001164277.1(SLC37A4): c.1099G>A (p.Ala367Thr) | CCACRCCATTGTGGGACTCATGG | Glucose-6-phosphate transport defect, not provided |
| 121908980 | SLC37A4 | NM_001164277.1(SLC37A4): c.1016G>A (p.Gly339Asp) | GTATTTGRTTTCTCCTCGTATGG | Glucose-6-phosphate transport defect, not provided |
| 121908979 | SLC37A4 | NM_001164277.1(SLC37A4): c.1243C>T (p.Arg415Ter) | CCTTCTTCCTCCTAYGAAACATC | Glucose-6-phosphate transport defect |
| 587777256 | SLC38A8 | NM_001080442.2(SLC38A8): c.1234G>A (p.Gly412Arg) | CCAGCACAGAGACCACTCYCCAG | |
| 121434363 | SLC39A13 | NM_001128225.2 (SLC39A13):c.221G>A (p.Gly74Asp) | TCCTGGRTTCCCTCATGGTGGGG, CTCCTGGRTTCCCTCATGGTGGG, CCTCCTGGRTTCCCTCATGGTGG | Spondylocheirodysplasia, Ehlers-Danlos syndrome-like |
| 121434288 | SLC39A4 | NM_130849.3(SLC39A4): c.1576G>A (p.Gly526Arg) | GACCRGGCTGGCCACCTCGCTGG | Hereditary acrodermatitis enteropathica |
| 121434292 | SLC39A4 | NM_130849.3(SLC39A4): c.283C>T (p.Arg95Cys) | CCAGGTACGTCGCCYGCCTCAGT | Hereditary acrodermatitis enteropathica |
| 121912621 | SLC45A2 | NM_016180.4(SLC45A2): c.469G>A (p.Asp157Asn) | TTGCTGCCRACTTCATTGATGGG | Oculocutaneous albinism type 4 |
| 730880270 | SLC45A2 | NM_016180.4(SLC45A2): c.563-1G>A | CCARGTTTTGGAGGTGCCCTGGG, TCCARGTTTTGGAGGTGCCCTGG | Oculocutaneous albinism type 4 |
| 794727511 | SLC45A2 | NM_016180.4(SLC45A2): c.856C>T (p.Gln286Ter) | CCAGAGCTGGCAATGYAGGGAGC | Oculocutaneous albinism type 4 |
| 121912741 | SLC4A1 | NM_000342.3(SLC4A1): c.2312G>A (p.Gly771Asp) | CACAGRCCTGTCCATCCTCATGG | Spherocytosis type 4 |
| 121912755 | SLC4A1 | NM_000342.3(SLC4A1): c.2279G>A (p.Arg760Gln) | GCAGCRGATCAGTGGACTCCTGG | Spherocytosis type 4 |
| 28929480 | SLC4A1 | NM_000342.3(SLC4A1): c.268G>A (p.Glu90Lys) | CTGGGGRAGAATGGGGCCTGGGG, CCTGGGGRAGAATGGGGCCTGGG, ACCTGGGGRAGAATGGGGCCTGG | Spherocytosis type 4 |
| 28931584 | SLC4A1 | NM_000342.3(SLC4A1): c.1462G>A (p.Val488Met) | ATCRTGGGCCGCGTGTGGATCGG, AGTACATCRTGGGCCGCGTGTGG | Renal tubular acidosis, distal, with hemolytic anemia, Spherocytosis type 4 |
| 387906565 | SLC4A1 | NM_000342.3(SLC4A1): c.-62G>A | CCCRCGGTGCGGGTTATGCTGGG, ACCCRCGGTGCGGGTTATGCTGG | Spherocytosis type 4 |
| 121912742 | SLC4A1 | NM_000342.3(SLC4A1): c.988C>T (p.Gln330Ter) | CCGATGCCCCCTCCGAGYAGGCA | Spherocytosis type 4 |
| 121912758 | SLC4A1 | NM_000342.3(SLC4A1): c.1936C>T (p.Arg646Trp) | CCAACTCCTCAGCCYGGGGCTGG | |
| 121912759 | SLC4A1 | NM_000342.3(SLC4A1): c.2603C>T (p.Pro868Leu) | CCTCATCCTCACTGTGCYGCTGC | |
| 28931585 | SLC4A1 | NM_000342.3(SLC4A1): c.2608C>T (p.Arg870Trp) | CCTCACTGTGCCGCTGYGGCGCG | Spherocytosis type 4 |
| 121909387 | SLC4A11 | NM_001174089.1(SLC4A11): c.2216G>A (p.Arg739Gln) | GAGACGCRGCTGACCTCGCTGGG, GGAGACGCRGCTGACCTCGCTGG | Corneal endothelial dystrophy type 2 |
| 121909392 | SLC4A11 | NM_001174089.1(SLC4A11): c.2558G>A (p.Arg853His) | CCCATCCRGTACAGGCGGGTGGG, CCCCATCCRGTACAGGCGGGTGG | Corneal endothelial dystrophy type 2 |
| 267607064 | SLC4A11 | NM_001174089.1(SLC4A11): c.2078G>A (p.Gly693Glu) | ACACAGRGCTGTCTCTGTTTGGG, AACACAGRGCTGTCTCTGTTTGG | Corneal dystrophy, Fuchs endothelial, 4 |
| 267607065 | SLC4A11 | NM_001174089.1(SLC4A11): c.1147G>A (p.Glu383Lys) | CAATGACRAGAACACAGACGGGG, TCAATGACRAGAACACAGACGGG | Corneal dystrophy, Fuchs endothelial, 4 |
| 121909390 | SLC4A11 | NM_001174089.1(SLC4A11): c.1765C>T (p.Arg589Ter) | CCTGCACCCCTGCGTGYGAGAGA | Corneal endothelial dystrophy type 2 |
| 121909391 | SLC4A11 | NM_001174089.1(SLC4A11): c.2557C>T (p.Arg853Cys) | CCATGATCCCCATCYGGTACAGG | Corneal endothelial dystrophy type 2 |
| 121908857 | SLC4A4 | NM_001098484.2(SLC4A4): c.1661G>A (p.Arg554His) | TTCRCCTTTGGATTGGCCTGTGG | Renal tubular acidosis, proximal, with ocular abnormalities and mental retardation |
| 375088539 | SLC52A2 | NM_001253815.1(SLC52A2): c.808C>T (p.Gln270Ter) | CCAGACCCTAAGGCCTATYAGCT | Brown-Vialetto-Van Laere syndrome 2 |
| 267606684 | SLC52A3 | NM_033409.3(SLC52A3): c.394C>T (p.Arg132Trp) | CCTGCCGTTCATGAGCYGGCTGC | Brown-Vialetto-Van laere syndrome |
| 121918621 | SLC5A2 | NM_003041.3(SLC5A2): c.1320G>A (p.Trp440Ter) | CTGRCTTCCCGTGGTGCAGGCGG, GGCCTGRCTTCCCGTGGTGCAGG | Familial renal glucosuria |
| 121434347 | SLC6A19 | NM_001003841.2(SLC6A19): c.718C>T (p.Arg240Ter) | CCTGACCATCTTCCTCATCYGAG, CCATCTTCCTCATCYGAGGCCTG | Neutral 1 amino acid transport defect |
| 17279437 | SLC6A20 | NM_020208.3(SLC6A20): c.596C>T (p.Thr199Met) | GCCRTGAAATACACCACCTGCGG | Hyperglycinuria |
| 431905514 | SLC6A3 | NM_001044.4(SLC6A3): c.1031+1G>A | CTACAGRTGAGCCCCTAGCAGGG, GCTACAGRTGAGCCCCTAGCAGG | Infantile Parkinsonism-dystonia |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 431905516 | SLC6A3 | NM_001044.4(SLC6A3): c.1561C>T (p.Arg521Trp) | CCCAGCCTGTACTGGYGGCTGTG, CCAGCCTGTACTGGYGGCTGTGC | Infantile Parkinsonism-dystonia |
| 122453113 | SLC6A8 | NM_005629.3(SLC6A8): c.1540C>T (p.Arg514Ter) | CCTGTATGATCGGGTACYGACCT | Creatine deficiency, X-linked |
| 121908482 | SLC7A9 | NM_014270.4(SLC7A9): c.583G>A (p.Gly195Arg) | CATCAGCRGGCTGGTGCTCCTGG | Cystinuria |
| 121908483 | SLC7A9 | NM_014270.4(SLC7A9): c.775G>A (p.Gly259Arg) | CATCRGGATCCCCCTGGTGACGG | Cystinuria |
| 121908486 | SLC7A9 | NM_014270.4(SLC7A9): c.782C>T (p.Pro261Leu) | CCATTATCATCGGGATCCYCCTG | Cystinuria |
| 786204831 | SLC9A1 | NM_003047.4(SLC9A1): c.913G>A (p.Gly305Arg) | GGGCRGGGTGCTTGTGGGCGTGG | LICHTENSTEIN-KNORR SYNDROME |
| 119486097 | SLC9A3R1 | NM_004252.4(SLC9A3R1): c.673G>A (p.Glu225Lys) | GGACRAGACCAAGCTGCTGGTGG, CGGGGACRAGACCAAGCTGCTGG | Nephrolithiasis/osteoporosis, hypophosphatemic, 2 |
| 796053283 | SLC9A6 | NM_006359.2(SLC9A6): c.1631+1G>A | TCATAARTATCCTTAATTGAGGG, ATCATAARTATCCTTAATTGAGG | not provided |
| 398124224 | SLC9A6 | NM_001042537.1(SLC9A6): c.1072C>T (p.Gln358Ter) | CCAAATTACGGAGTTCYAGTTG | not provided |
| 387906806 | SLCO2A1 | NM_005630.2(SLCO2A1): c.764G>A (p.Gly255Glu) | TGGATTGRAGCCTGGTGGCTAGG | Primary hypertrophic osteoarthropathy, autosomal recessive 2 |
| 587777071 | SLITRK6 | NM_032229.2(SLITRK6): c.541C>T (p.Arg181Ter) | ACAAATCRAAGATGTTTGGAGG | Deafness, cochlear, with myopia and intellectual impairment |
| 121908317 | SLURP1 | NM_020427.2(SLURP1): c.286C>T (p.Arg96Ter) | CCTGATCTTCTGCTGCTTCYGAG | Acroerythrokeratoderma |
| 587776602 | SLURP1 | NM_020427.2(SLURP1): c.178+1G>A | CCGTGGGGCCTGGCCTCAYCTGC | Acroerythrokeratoderma |
| 387906852 | SMAD3 | NM_005902.3(SMAD3): c.836G>A (p.Arg279Lys) | TGTCAACARGAATGCAGCAGTGG | Loeys-Dietz syndrome 3 |
| 387906853 | SMAD3 | NM_005902.3(SMAD3): c.715G>A (p.Glu239Lys) | TACRAGCTGAACCAGCGCGTCGG | Loeys-Dietz syndrome 3, not provided |
| 377767342 | SMAD4 | NM_005359.5(SMAD4): c.988G>A (p.Glu330Lys) | TTTRAAATGGATGTTCAGGTAGG, TTACTTTRAAATGGATGTTCAGG | |
| 121912581 | SMAD4 | NM_005359.5(SMAD4): c.1054G>A (p.Gly352Arg) | GATRGATACGTGGACCCTTCTGG | Juvenile polyposis/hereditary hemorrhagic telangiectasia syndrome, not provided |
| 377767345 | SMAD4 | NM_005359.5(SMAD4): c.1055G>A (p.Gly352Glu) | GATGRATACGTGGACCCTTCTGG | Juvenile polyposis/hereditary hemorrhagic telangiectasia syndrome |
| 377767356 | SMAD4 | NM_005359.5(SMAD4): c.1168G>A (p.Glu390Lys) | CAGTTGRAATGTAAAGGTGAAGG | Juvenile polyposis syndrome |
| 377767326 | SMAD4 | NM_005359.5(SMAD4): c.403C>T (p.Arg135Ter) | CCATATCACTACGAAYGAGTTGT | Juvenile polyposis syndrome |
| 387907194 | SMARCA2 | NM_003070.4(SMARCA2): c.3395G>A (p.Gly1132Asp) | TGGCCTGGRCTTAAATCTTCAGG | Nicolaides-Baraitser syndrome |
| 281875188 | SMARCA2 | NM_003070.4(SMARCA2): c.2648C>T (p.Pro883Leu) | CCTCTTGACTGGGACCCYGCTGC | Nicolaides-Baraitser syndrome, not provided |
| 587777460 | SMARCA4 | NM_003072.3(SMARCA4): c.3533G>A (p.Trp1178Ter) | CAGCGACTRGAATCCTCACCAGG | Rhabdoid tumor predisposition syndrome 2 |
| 587777461 | SMARCA4 | NM_001128845.1(SMARCA4): c.4071+1G>A | GCTCAAGRTACATGCTGGAGAGG | Rhabdoid tumor predisposition syndrome 2 |
| 587777462 | SMARCA4 | NM_001128849.1(SMARCA4): c.643C>T (p.Gln215Ter) | CCGATGCCCGGGATGCAGYAGCA | Rhabdoid tumor predisposition syndrome 2 |
| 267607070 | SMARCA4 | NM_001128844.1(SMARCA4): c.3565C>T (p.Arg1189Ter) | CCTGCAAGCGCAGGACYGAGCCC | Rhabdoid tumor predisposition syndrome 2 |
| 387906812 | SMARCB1 | NM_003073.3(SMARCB1): c.1130G>A (p.Arg377His) | GATGAGGCRTCTTGCCAACACGG | Mental retardation, autosomal dominant 15 |
| 121434496 | SMARCB1 | NM_003073.3(SMARCB1): c.544C>T (p.Gln182Ter) | CCATGAGAACGCATCTYAGCCCG | |
| 122454123 | SMC1A | NM_006306.3(SMC1A): c.1487G>A (p.Arg496His) | GAGCAGCCRCCAGCAGCGAAAGG | Congenital muscular hypertrophy-cerebral syndrome |
| 587784409 | SMC1A | NM_006306.3(SMC1A): c.2131C>T (p.Arg711Trp) | CCCATGGACTGCAGATGYGGCTC, CCATGGACTGCAGATGYGGCTCA | Congenital muscular hypertrophy-cerebral syndrome |
| 727503776 | SMC | NM_006306.3(SMC1A): c.121C>T (p.Leu41Phe) | CCCTTAGGTAAGTCAAATYTCAT, CCTTAGGTAAGTCAAATYTCATG | Wiedemann-Steiner syndrome |
| 104893930 | SMN1 | NM_000344.3(SMN1): c.88G>A (p.Asp30Asn) | GAGCGATRATTCTGACATTTGGG, AGAGCGATRATTCTGACATTTGG | Spinal muscular atrophy, type II |
| 120074119 | SMPD1 | NM_000543.4(SMPD1): c.1735G>A (p.Gly579Ser) | CCATAAGRGCCACCCACCCTCGG | Niemann-Pick disease, type A |
| 397515550 | SMS | NM_004595.4(SMS): c.200G>A (p.Gly67Glu) | CCCACATGRATTGGTGTTGCTGG | Snyder Robinson syndrome |
| 104893875 | SNCA | NM_000345.3(SNCA): c.136G>A (p.Glu46Lys) | ACCAAGRGGGAGTGGTGCATGG | Lewy body dementia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893936 | SNCB | NM_001001502.1(SNCB): c.208G>A (p.Val70Met) | GAGCTRTGTTCTCTGGGGCAGGG, GGAGCTRTGTTCTCTGGGGCAGG | Lewy body dementia |
| 527236113 | SNRNP200 | NM_014014.4(SNRNP200): c.2042G>A (p.Arg681His) | TAGCTTCCRTCCAGTGCCTCTGG | Retinitis pigmentosa |
| 267607078 | SOBP | NM_018013.3(SOBP): c.1981C>T (p.Arg661Ter) | CCTGACCGTGGGCCACYGAGCCC | Mental retardation, anterior maxillary protrusion, and strabismus |
| 121912444 | SOD1 | NM_000454.4(SOD1): c.13G>A (p.Ala5Thr) | AAGRCCGTGTGCGTGCTGAAGGG, GAAGRCCGTGTGCGTGCTGAAGG | Amyotrophic lateral sclerosis type 1 |
| 121912447 | SOD1 | NM_000454.4(SOD1): c.436G>A (p.Ala146Thr) | GTTTGRCTTGTGGTGTAATTGGG, CGTTTGRCTTGTGGTGTAATTGG | Amyotrophic lateral sclerosis type 1 |
| 121912450 | SOD1 | NM_000454.4(SOD1): c.64G>A (p.Glu22Lys) | TTCRAGCAGAAGGCAAGGGCTGG, CAATTTCRAGCAGAAGGCAAGGG, TCAATTTCRAGCAGAAGGCAAGG | Amyotrophic lateral sclerosis type 1 |
| 397517147 | SOS1 | NM_005633.3(SOS1): c.1297G>A (p.Glu433Lys) | GGTTGGRAGGGAAAAGACATTGG | Noonan syndrome 4, Rasopathy, not provided |
| 397517159 | SOS1 | NM_005633.3(SOS1): c.2536G>A (p.Glu846Lys) | TTTARAGAAAGAGTAGCTGTGG | Noonan syndrome 4, Rasopathy |
| 727504295 | SOS1 | NM_005633.3(SOS1): c.1322G>A (p.Cys441Tyr) | GTGTTRTAATGAATTTATAATGG | Noonan syndrome 4, Rasopathy |
| 104894644 | SOST | NM_025237.2(SOST): c.372G>A (p.Trp124Ter) | GCAAGTGRTGGCGACCTAGTGGG, GGCAAGTGRTGGCGACCTAGTGG | Sclerosteosis |
| 387907169 | SOST | NM_025237.2(SOST): c.61G>A (p.Val21Met) | GTGTARTGGAGGGCCAGGGGTGG, TCCGTGTARTGGAGGGCCAGGGG | Craniodiaphyseal dysplasia, autosomal dominant |
| 104894645 | SOST | NM_025237.2(SOST): c.376C>T (p.Arg126Ter) | CCGCGGCAAGTGGTGGYGACCTA | Sclerosteosis |
| 387906320 | SOST | NM_025237.2(SOST): c.70C>T (p.Gln24Ter) | CCGTGTAGTGGAGGGCYAGGGGT | Sclerosteosis |
| 121908510 | SPAST | NM_014946.3(SPAST): c.1343G>A (p.Cys448Tyr) | TTTGTRTGAAAGAAGAGAAGGGG, TTTTGTRTGAAAGAAGAGAAGGG, CTTTTGTRTGAAAGAAGAGAAGG | Spastic paraplegia 4, autosomal dominant |
| 149688478 | SPATA5 | NM_145207.2(SPATA5): c.1714+1G>A | CAGRTGAGTGTGGTTTGCTATGG | not provided |
| 796051895 | SPATA5 | NM_145207.2(SPATA5): c.298G>A (p.Ala100Thr) | TATACARCCTGGCCTATGGCAGG | not provided, EPILEPSY, HEARING LOSS, AND MENTAL RETARDATION SYNDROME |
| 200793464 | SPG11 | NM_025137.3(SPG11): c.5974C>T (p.Arg1992Ter) | GTCRACAGTAGTTCTTCCCATGG | Spastic paraplegia 11, autosomal recessive, Amyotrophic lateral sclerosis type 5 |
| 312262785 | SPG11 | NM_025137.3(SPG11): c.6856C>T (p.Arg2286Ter) | CCTCAGGACTCCTGTGTGYGACA | Spastic paraplegia 11, autosomal recessive |
| 267607084 | SPG11 | NM_025137.3(SPG11): c.118C>T (p.Gln40Ter) | CCCCGCCGAGGCGATGGGGYAGC, CCCGCCGAGGCGATGGGGYAGCT, CCGCCGAGGCGATGGGGYAGCTC, CCGAGGCGATGGGGYAGCTCGGC | Spastic paraplegia 11, autosomal recessive, Amyotrophic lateral sclerosis type 5 |
| 606231154 | SPINT2 | NM_021102.3(SPINT2): c.593-1G>A | CCTCARTGGTGGTTCTGGCGGGG, TCCTCARTGGTGGTTCTGGCGGG, GTCCTCARTGGTGGTTCTGGCGG | Diarrhea 3, secretory sodium, congenital, syndromic |
| 104893666 | SPR | NM_003124.4(SPR): c.488C>T (p.Pro163Leu) | CCCTCTGTGCCCTGCAACYTTTC, CCTCTGTGCCCTGCAACYTTTCA | Sepiapterin reductase deficiency |
| 121917746 | SPR | NM_003124.4(SPR): c.355C>T (p.Gln119Ter) | CCTGAGTGACTCCACTYAAGTGA | Sepiapterin reductase deficiency |
| 769987150 | SPTBN2 | NM_006946.2(SPTBN2): c.1915G>T (p.Glu639Ter) | CCAGAGCCGCCGTGATTYCTCCA | Multiple congenital anomalies |
| 267607090 | SPTLC2 | NM_004863.3(SPTLC2): c.1075G>A (p.Val359Met) | CGGGGTRTGGTGGAGTACTTTGG | NEUROPATHY, HEREDITARY SENSORY, TYPE IC |
| 796051870 | SQSTM1 | NM_003900.4(SQSTM1): c.970_1165del | CGCCAGRCAAGTGAACCAAGAGG | Paget disease of bone, familial |
| 776749939 | SQSTM1 | NM_003900.4(SQSTM1): c.1160C>T (p.Pro387Leu) | CCTTGTACCCACATCTCCYGCCA | FRONTOTEMPORAL DEMENTIA AND/OR AMYOTROPHIC LATERAL SCLEROSIS 3 |
| 147810437 | SQSTM1 | NM_001142298.1(SQSTM1): c.98C>T (p.Ala33Val) | CCACCGTGTGCTCAGGAGGYGCC, CCGTGTGCTCAGGAGGYGCCCCG | FRONTOTEMPORAL DEMENTIA AND/OR AMYOTROPHIC LATERAL SCLEROSIS 3 |
| 121913314 | SRC | NM_198291.2(SRC): c.1591C>T (p.Gln531Ter) | CCACCGAGCCCAGTACYAGCCC, CCGAGCCCCAGTACYAGCCCGGG | |
| 199469464 | SRCAP | NM_006662.2(SRCAP): c.7330C>T (p.Arg2444Ter) | CCAGCACCTAGGCCYTGACCCAC | Floating-Harbor syndrome |
| 587777656 | SRCAP | NM_006662.2(SRCAP): c.7000C>T (p.Gln2334Ter) | CCGAGAGGAGCTCAAAYAGGCAG | Floating-Harbor syndrome |
| 121434246 | SRD5A2 | NM_000348.3(SRD5A2): c.344G>A (p.Gly115Asp) | AGAGRCACTGCCTTCTGCACTGG | 3-Oxo-5 alpha-steroid delta 4-dehydrogenase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434250 | SRD5A2 | NM_000348.3(SRD5A2): c.586G>A (p.Gly196Ser) | TCCTCRGTGAGATCATTGAATGG | 3-Oxo-5 alpha-steroid delta 4-dehydrogenase deficiency |
| 104894965 | SRY | NM_003140.2(SRY): c.209G>A (p.Trp70Ter) | TCGTGTRGTCTCGCGATCAGAGA | 46,XY sex reversal, type 1 |
| 104894966 | SRY | NM_003140.2(SRY): c.337G>A (p.Ala113Thr) | CCAGGAGRCACAGAAATTACAGG | 46,XY sex reversal, type 1 |
| 104894967 | SRY | NM_003140.2(SRY): c.320G>A (p.Trp107Ter) | AAAATRGCCATTCTTCCAGGAGG, CGAAAAATRGCCATTCTTCCAGG | 46,XY sex reversal, type 1 |
| 104894969 | SRY | NM_003140.2(SRY): c.192G>A (p.Met64Ile) | CCATRACGCATTCATCGTGTGG | 46,XY sex reversal, type 1 |
| 104894977 | SRY | NM_003140.2(SRY): c.4C>T (p.Gln2Ter) | CCTTGTTTTTGACAATGYAATCA | 46,XY sex reversal, type 1 |
| 104893668 | ST3GAL5 | NM_003896.3(ST3GAL5): c.862C>T (p.Arg288Ter) | CCTTAGCCATTCTGGGTAYGACT | Amish infantile epilepsy syndrome |
| 534438354 | ST3GAL5 | NM_003896.3(ST3GAL5): c.1063G>A (p.Glu355Lys) | CCCGCCAAACTGACTTYATCGCA, CCGCCAAACTGACTTYATCGCAC | Amish infantile epilepsy syndrome |
| 397509388 | STAMBP | NM_201647.2(STAMBP): c.532C>T (p.Arg178Ter) | CCAGGAGCTAGAAAAAGAGYGAC | Microcephaly-capillary malformation syndrome |
| 397509390 | STAMBP | NM_201647.2(STAMBP): c.1270C>T (p.Arg424Ter) | CCATCACAGACCTTYGATGAGCG | Microcephaly-capillary malformation syndrome |
| 143739249 | STAMBP | NM_201647.2(STAMBP): c.112C>T (p.Arg38Cys) | CCACCCGTCGGTACTTCYGCTC, CCCCGTCGGTACTTCYGCTCTGG, CCCGTCGGTACTTCYGCTCTGGA | Microcephaly-capillary malformation syndrome |
| 104894085 | STAR | NM_000349.2(STAR): c.772C>T (p.Gln258Ter) | CCCAAGAGCATCATCAACYAGGT, CCAAGAGCATCATCAACYAGGTC | Cholesterol monooxygenase (side-chain cleaving) deficiency |
| 104894090 | STAR | NM_000349.2(STAR): c.562C>T (p.Arg188Cys) | CCGTGACTTTGTGAGCGTGYGCT | Cholesterol monooxygenase (side-chain cleaving) deficiency |
| 387906759 | STAT1 | NM_007315.3(STAT1): c.800C>T (p.Ala267Val) | CCCAGGTTCACTATAGTTGYGGA, CCAGGTTCACTATAGTTGYGGAG | Immunodeficiency 31C |
| 587777647 | STAT3 | NM_003150.3(STAT3): c.2147C>T (p.Thr716Ile) | CAGRTCGTTCTGTAGGAAATGGG, GCAGRTCGTTCTGTAGGAAATGG | Autoimmune disease, multisystem, infantile-onset |
| 113994135 | STAT3 | NM_139276.2(STAT3): c.1144C>T (p.Arg382Trp) | CCCCTGTGATTCAGATCCYGGAA, CCCTGTGATTCAGATCCYGGAAA, CCTGTGATTCAGATCCYGGAAAT | Hyperimmunoglobulin E syndrome |
| 121908502 | STAT5B | NM_012448.3(STAT5B): c.454C>T (p.Arg152Ter) | CCAGACGTTTGAGGAGCTGYGAC | Growth hormone insensitivity with immunodeficiency |
| 397515390 | STIM1 | NM_003156.3(STIM1): c.970-1G>A | CCTARGTTCGGGAGGCCTTGAGG | Immune dysfunction with T-cell inactivation due to calcium entry defect 2 |
| 483352867 | STIM1 | NM_003156.3(STIM1): c.910C>T (p.Arg304Trp) | CCAGCGGCTGAAGGAGCTGYGGG | Stormorken syndrome |
| 730881979 | STK11 | NM_000455.4(STK11): c.526G>A (p.Asp176Asn) | TGCACAAGRACATCAAGCCGGGG | Hereditary cancer-predisposing syndrome |
| 121913323 | STK11 | NM_000455.4(STK11): c.508C>T (p.Gln170Ter) | CCTGGAGTACCTGCATAGCYAGG | Cutaneous malignant melanoma 1 |
| 786201090 | STK11 | NM_000455.4(STK11): c.910C>T (p.Arg304Trp) | CCATCCGGCAGATCYGGCAGCAC | Hereditary cancer-predisposing syndrome |
| 397514639 | STRA6 | NM_001142617.1(STRA6): c.1964G>A (p.Arg655His) | TTCCRCAAGACGGCCCTGTTGGG, CTTCCRCAAGACGGCCCTGTTGG | Microphthalmia syndromic 9 |
| 267607096 | STRA6 | NM_001142617.1(STRA6): c.69G>A (p.Trp23Ter) | CTGRTACATCGATGAGCCCCAGG | Microphthalmia syndromic 9 |
| 118203959 | STRA6 | NM_001142617.1(STRA6): c.1963C>T (p.Arg655Cys) | CCCAACCCTGCAGGTCTTCYGCA, CCAACCCTGCAGGTCTTCYGCAA, CCCTGCAGGTCTTCYGCAAGACG | Microphthalmia syndromic 9 |
| 118203961 | STRA6 | NM_001142617.1(STRA6): c.269C>T (p.Pro90Leu) | CCTTGCCTCTGTGCTAGCCYTGT, CCTCTGTGCTAGCCYTGTGGATT | Microphthalmia syndromic 9 |
| 377480477 | STRC | NM_153700.2(STRC): c.4402C>T (p.Arg1468Ter) | CCTCRTACATCTGCACAATTTGG | Deafness, autosomal recessive 16 |
| 137853167 | STS | NM_000351.4(STS): c.1022C>T (p.Ser341Leu) | CCCTCATCTACTTCACATYGGAC, CCTCATCTACTTCACATYGGACC | X-linked ichthyosis with steryl-sulfatase deficiency |
| 587777346 | STUB1 | NM_005861.3(STUB1): c.235G>A (p.Ala79Thr) | AGCAGRCCCTGGCCGACTGCCGG | Spinocerebellar ataxia, autosomal recessive 16 |
| 587777310 | STXBP1 | NM_003165.3(STXBP1): c.847G>A (p.Glu283Lys) | TGGACRAGGACGACGACCTGTGG | Early infantile epileptic encephalopathy 4 |
| 796053356 | STXBP1 | NM_003165.3(STXBP1): c.569G>A (p.Arg190Gln) | GCTGTGCRGTATCGGGGGTAAGG | not provided |
| 796053360 | STXBP1 | NM_003165.3(STXBP1): c.795-1G>A | CATTCTARGTATGAGACCAGCGG | not provided |
| 796053365 | STXBP1 | NM_003165.3(STXBP1): c.1061G>A (p.Cys354Tyr) | GACTRTATGAAGCATTACCAAGG | not provided |
| 121918318 | STXBP1 | NM_003165.3(STXBP1): c.539G>A (p.Cys180Tyr) | GACCCTTTRTGCCACCCTGAAGG | Early infantile epileptic encephalopathy 4 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796053366 | STXBP1 | NM_003165.3(STXBP1): c.1099C>T (p.Arg367Ter) | CCGTAGACAAACTCTGCYGAGTG | not provided |
| 796053376 | STXBP1 | NM_003165.3(STXBP1): c.1672C>T (p.Gln558Ter) | CCTACGAGGTGACCYAGGCCAAC | not provided |
| 28942088 | SUFU | NM_016169.3(SUFU): c.44C>T (p.Pro15Leu) | CGGGRGCGCGGTGGGGCCGGGGG, CCGGGRGCGCGGTGGGGCCGGG, GCCGGGRGCGCGGTGGGGCCGGG, GGCCGGGRGCGCGGTGGGGCCGG | Medulloblastoma |
| 137852854 | SUMF1 | NM_182760.3(SUMF1): c.653G>A (p.Cys218Tyr) | ACTRCACTTGGGCAGGGAAGCGG | Multiple sulfatase deficiency |
| 137852845 | SUMF1 | NM_182760.3(SUMF1): c.979C>T (p.Arg327Ter) | CCCCCTTCTGGGAAAGACYGAGT, CCCCTTCTGGGAAAGACYGAGTG, CCCTTCTGGGAAAGACYGAGTGA, CCTTCTGGGAAAGACYGAGTGAA | Multiple sulfatase deficiency |
| 121908009 | SUOX | NM_000456.2(SUOX): c.1589G>A (p.Gly530Asp) | GAGRTGTTCTCAGCAATGCCTGG | Sulfite oxidase deficiency, isolated |
| 397514679 | SYN1 | NM_006950.3(SYN1): c.1663C>T (p.Gln555Ter) | CCCGCCTCTCCGTCTCCCYAGCG, CCGCCTCTCCGTCTCCCYAGCGC, CCTCTCCGTCTCCCYAGCGCCAG | Epilepsy, X-linked, with variable learning disabilities and behavior disorders |
| 397514670 | SYNGAP1 | NM_006772.2(SYNGAP1): c.1685C>T (p.Pro562Leu) | CCCCCCAGCGTGTTCCYGAGGGA, CCCCCAGCGTGTTCCYGAGGGAG, CCCCAGCGTGTTCCYGAGGGAGC | Mental retardation, autosomal dominant 5 |
| 398122403 | SYNJ1 | NM_203446.2(SYNJ1): c.773G>A (p.Arg258Gln) | GTCCRGGGAACAAATGATGATGG | Parkinson disease 20, early-onset |
| 267607101 | TAB2 | NM_015093.5(TAB2): c.622C>T (p.Pro208Ser) | CCACCTGTACTTAACAGTYCACA, CCTGTACTTAACAGTYCACAGGG | Congenital heart disease, multiple types, 2 |
| 144292455 | TACR3 | NM_001059.2(TACR3): c.824G>A (p.Trp275Ter) | CCTGGGATTTCTCCTCCCYAGAG | Hypogonadotropic hypogonadism 11 with or without anosmia |
| 80358223 | TACSTD2 | NM_002353.2(TACSTD2): c.352C>T (p.Gln118Ter) | CCGCTTCAAGGCGCGCYAGTGCA | Lattice corneal dystrophy Type III |
| 80358224 | TACSTD2 | NM_002353.2(TACSTD2): c.619C>T (p.Gln207Ter) | CCAGATCGAGCTGCGGYAGAACA | Lattice corneal dystrophy Type III |
| 397509359 | TAR | NR_104387.1(TAF1): n.5894C>T | CCAAGGCTTTGAGTCTCTTYGTC | Dystonia 3, torsion, X-linked |
| 4884357 | TARDBP | NM_007375.3(TARDBP): c.892G>A (p.Gly298Ser) | GCTRTTTTGGGAAACAATCAAGG | Amyotrophic lateral sclerosis type 10 |
| 387906334 | TARDBP | NM_007375.3(TARDBP): c.*697G>A | ATCCRCTACTCTTTATTTCATGG | Amyotrophic lateral sclerosis type 10, FRONTOTEMPORAL DEMENTIA WITH TDP43 INCLUSIONS, TARDBP-RELATED |
| 794729167 | TAZ | NM_000116.4(TAZ): c.582G>A (p.Trp194Ter) | TCAAGTGRGGTAAGGGCTGCTGG | not provided |
| 794729174 | TAZ | NM_000116.4(TAZ): c.526C>T (p.His176Tyr) | CCATGGGGACTGGGTGYATATCT | not provided |
| 587777157 | TBC1D20 | NM_144628.3(TBC1D20): c.199C>T (p.Arg67Ter) | TTCRTCTGATCTCATCAGTCAGG | Warburg micro syndrome 4 |
| 398122968 | TBC1D24 | NM_001199107.1(TBC1D24): c.1206+5G>A | TGARCAGGGGCCCTGGAGCCAGG | Digitorenocerebral syndrome |
| 483352866 | TBC1D24 | NM_001199107.1(TBC1D24): c.533C>T (p.Ser178Leu) | CCTGGCCTTTGAGTYGTCCTGCA | Deafness, autosomal recessive 86, Deafness, autosomal dominant 65 |
| 748112833 | TBK1 | NM_013254.3(TBK1): c.2086G>A (p.Glu696Lys) | AAAGGAARAGATGGAAGGGGTGG | FRONTOTEMPORAL DEMENTIA AND/OR AMYOTROPHIC LATERAL SCLEROSIS 4 |
| 137852955 | TBX20 | NM_001077653.2(TBX20): c.583C>T (p.Gln195Ter) | CCTTTTACCGGTGAGYAACTACT | Atrial septal defect 4 |
| 104894648 | TBX4 | NM_018488.2(TBX4): c.184C>T (p.Gln62Ter) | CCGCCGCCGCCGCGGAGYAGGTA, CCGCCGCCGCGGAGYAGGTAGGG | Ischiopatellar dysplasia |
| 104894382 | TBX5 | NM_000192.3(TBX5): c.709C>T (p.Arg237Trp) | CCCTTTGCCAAAGGATTTYGGGG, CCTTTGCCAAAGGATTTYGGGGC | Holt-Oram syndrome, Malformation of the heart, not provided |
| 199422117 | TBXAS1 | NM_001061.4(TBXAS1): c.1238G>A (p.Arg413Gln) | ATTCACACRGGAGGCAGCTCAGG | |
| 775636212 | TCAP | NM_003673.3(TCAP): c.208C>T (p.Arg70Trp) | CCCTGGCTGATGATGYGGATGGG, CCTGGCTGATGATGYGGATGGGC | Dilated cardiomyopathy 1N, Hypertrophic cardiomyopathy |
| 777518512 | TCAP | NM_003673.3(TCAP): c.259C>T (p.Arg87Trp) | CCAGCTGCCCTACCAGYGGGTAC | not provided |
| 398123560 | TCF4 | NM_001083962.1(TCF4): c.1086G>A (p.Trp362Ter) | TTGRTCTAGAAATGGAGGACAGG, GCTGTTTGRTCTAGAAATGGAGG | Pitt-Hopkins syndrome |
| 121909120 | TCF4 | NM_001083962.1(TCF4): c.1738C>T (p.Arg580Trp) | CCCGAGAGCGTCTGYGGGTCCGT | Pitt-Hopkins syndrome |
| 727505396 | TCF4 | NM_001083962.1(TCF4): c.1438C>T (p.Gln480Ter) | CCACAGCTTCCTGTCYAGTCTGC | Pitt-Hopkins syndrome |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 139617644 | TCIRG1 | NM_006019.3(TCIRG1): c.1674-1G>A | CCGCCARGCACTTTGGCCAGAGG | Osteopetrosis autosomal recessive 1 |
| 137853150 | TCIRG1 | NM_006019.3(TCIRG1): c.1213G>A (p.Gly405Arg) | TGTTCRGGGATGTGGGCCACGGG, ATGTTCRGGGATGTGGGCCACGG | Osteopetrosis autosomal recessive 1 |
| 119470017 | TCOF1 | NM_000356.3(TCOF1): c.2731C>T (p.Arg911Ter) | CCCCGAGGAAGGCCYGAGCCTCG | Treacher collins syndrome 1 |
| 267607107 | TECTA | NM_005422.2(TECTA): c.5471G>A (p.Gly1824Asp) | CAGCTCGRTTTTGAGAGGGAGGG, CCAGCTCGRTTTTGAGAGGGAGG | Deafness, autosomal dominant 12 |
| 281865415 | TECTA | NM_005422.2(TECTA): c.5458C>T (p.Leu1820Phe) | CCATATCTAAGTGCAAGYTCTTC | Deafness, autosomal dominant 12 |
| 387906745 | TEK | NM_000459.4(TEK): c.2744G>A (p.Arg915His) | CCTTCRCAAGAGCCGTGTGCTGG | Multiple Cutaneous and Mucosal Venous Malformations |
| 199422287 | TERC | NR_001566.1(TERC): n.450G>A | CATRCAGTTCGCTTTCCTGTTGG | Aplastic anemia |
| 199422280 | TERC | NR_001566.1(TERC): n.322G>A | GTCAGCCRCGGGTCTCTCGGGGG, TGTCAGCCRCGGGTCTCTCGGGG | Aplastic anemia |
| 199422260 | TERC | NR_001566.1(TERC): n.35C>T | CCTGGGAGGGGTGGTGGYCATTT | Dyskeratosis congenita autosomal dominant |
| 199422291 | TERT | NM_198253.2(TERT): c.430G>A (p.Val144Met) | CCGCRTGGGCGACGACGTGCTGG | Idiopathic fibrosing alveolitis, chronic form |
| 149566858 | TERT | NM_198253.2(TERT): c.2177C>T (p.Thr726Met) | CCTCCRTGAGCCTGTCCTGGGGG, ACCTCCRTGAGCCTGTCCTGGGG, GACCTCCRTGAGCCTGTCCTGGG, TGACCTCCRTGAGCCTGTCCTGG | Dyskeratosis congenita autosomal dominant |
| 121918662 | TERT | NM_198253.2(TERT): c.2080G>A (p.Val694Met) | CACCTTCRTGCTGCGTGTGCGGG, GCACCTTCRTGCTGCGTGTGCGG | Aplastic anemia, PULMONARY FIBROSIS AND/OR BONE MARROW FAILURE, TELOMERE-RELATED, 1 |
| 121918664 | TERT | NM_198253.2(TERT): c.3268G>A (p.Val1090Met) | TCACCTACRTGCCACTCCTGGGG | Aplastic anemia, PULMONARY FIBROSIS AND/OR BONE MARROW FAILURE, TELOMERE-RELATED, 1 |
| 199422294 | TERT | NM_198253.2(TERT): c.1892G>A (p.Arg631Gln) | GCTGCRGCCGATTGTGAACATGG | Idiopathic fibrosing alveolitis, chronic form, Dyskeratosis congenita, autosomal dominant, 2 |
| 199422295 | TERT | NM_198253.2(TERT): c.2045G>A (p.Gly682Asp) | TGGRCCTGGACGATATCCACAGG | Dyskeratosis congenita autosomal dominant |
| 199422309 | TERT | NM_198253.2(TERT): c.219+1G>A | CAGRTGGGCCTCCCCGGGGTCGG, CCGCCAGRTGGGCCTCCCCGGGG, TCCGCCAGRTGGGCCTCCCCGGG | Idiopathic fibrosing alveolitis, chronic form, PULMONARY FIBROSIS AND/OR BONE MARROW FAILURE, TELOMERE-RELATED, 1 |
| 199422293 | TERT | NM_198253.2(TERT): c.1456C>T (p.Arg486Cys) | CCAGGCACAACGAACGCYGCTTC | Idiopathic fibrosing alveolitis, chronic form |
| 199422297 | TERT | NM_198253.2(TERT): c.2110C>T (p.Pro704Ser) | CCCAGGACCCGCCGYCTGAGCTG | Dyskeratosis congenita autosomal dominant, Dyskeratosis congenita, autosomal recessive, 4 |
| 199422301 | TERT | NM_198253.2(TERT): c.2431C>T (p.Arg811Cys) | CCTCTTCGACGTCTTCCTAYGCT | Dyskeratosis congenita autosomal recessive 1, Dyskeratosis congenita, autosomal recessive, 4 |
| 141425941 | TERT | NM_198253.2(TERT): c.2371G>A (p.Val791Ile) | CCCAGACCTGCTCGATGAYGACG, CCAGACCTGCTCGATGAYGACGG | PULMONARY FIBROSIS AND/OR BONE MARROW FAILURE, TELOMERE-RELATED, 1 |
| 121918676 | TF | NM_001063.3(TF): c.830G>A (p.Gly277Asp) | GCGRCAAGGAGGACTTGATCTGG | |
| 121918681 | TF | NM_001063.3(TF): c.229G>A (p.Asp77Asn) | CGAAGCGRATGCTGTGACACTGG | Atransferrinemia |
| 80338876 | TFR2 | NM_003227.3(TFR2): c.64G>A (p.Val22Ile) | ACCRTCTACCAGCGTGTGGAAGG, TCAGACCRTCTACCAGCGTGTGG | Hemochromatosis type 3 |
| 80338881 | TFR2 | NM_003227.3(TFR2): c.949C>T (p.Gln317Ter) | CCAAGCCTGTCCAGCCAGYAGGC | Hemochromatosis type 3 |
| 80338882 | TFR2 | NM_003227.3(TFR2): c.1186C>T (p.Arg396Ter) | CCTGGGCCCCGGGCCAYGACTGC | Hemochromatosis type 3 |
| 121912650 | TG | NM_003235.4(TG): c.7007G>A (p.Arg2336Gln) | AGCTACCRAGTGGGTGTCTTCGG | Iodotyrosyl coupling defect |
| 121912646 | TG | NM_003235.4(TG): c.4588C>T (p.Arg1530Ter) | CCAGAATGGCCAGTATYGAGCCA | Iodotyrosyl coupling defect |
| 121909209 | TGFBI | NM_000358.2(TGFBI): c.1664G>A (p.Arg555Gln) | AGAGAACRGAGCAGACTCTTGGG, AAGAGAACRGAGCAGACTCTTGG | Thiel-Behnke corneal dystrophy |
| 121909208 | TGFBI | NM_000358.2(TGFBI): c.1663C>T (p.Arg555Trp) | CCCTGCCACCAAGAGAAYGGAGC, CCTGCCACCAAGAGAAYGGAGCA | Groenouw corneal dystrophy type I |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918712 | TGFBR1 | NM_004612.3(TGFBR1): c.599C>T (p.Thr200Ile) | CCATTGCTTGTTCAGAGAAYAAT | Loeys-Dietz syndrome 1 |
| 111854391 | TGFBR1 | NM_004612.3(TGFBR1): c.722C>T (p.Ser241Leu) | CCTCTAGAGAAGAACGTTYGTGG | Loeys-Dietz syndrome, Loeys-Dietz syndrome 1 |
| 104893816 | TGFBR2 | NM_003242.5(TGFBR2): c.1379G>A (p.Arg460His) | TCTCRCTGTAATGCAGTGGGAGG, ACATCTCRCTGTAATGCAGTGGG, GACATCTCRCTGTAATGCAGTGG | Loeys-Dietz syndrome 2, not provided |
| 104893809 | TGFBR2 | NM_003242.5(TGFBR2): c.1609C>T (p.Arg537Cys) | CCCAGTGTGTGGCAGAAYGCTTC, CCAGTGTGTGGCAGAAYGCTTCA | Loeys-Dietz syndrome 2, not provided |
| 104893810 | TGFBR2 | NM_003242.5(TGFBR2): c.1582C>T (p.Arg528Cys) | CCACGACCCAGAGGCCYGTCTCA | Loeys-Dietz syndrome 2, not provided |
| 35312232 | TGM1 | NM_000359.2(TGM1): c.1552G>A (p.Val518Met) | TATRTGGAGGAGAAGGCCATCGG | Autosomal recessive congenital ichthyosis 1 |
| 121918717 | TGM1 | NM_000359.2(TGM1): c.968G>A (p.Arg323Gln) | CTCCCRGGTCATCTCTGCCATGG | Autosomal recessive congenital ichthyosis 1 |
| 121918722 | TGM1 | NM_000359.2(TGM1): c.1147G>A (p.Val383Met) | GGCRTGACCACCACAGGTAGTGG | Autosomal recessive congenital ichthyosis 1 |
| 121918725 | TGM1 | NM_000359.2(TGM1): c.832G>A (p.Gly278Arg) | TACRGGACCGAAGCACAGATTGG | Autosomal recessive congenital ichthyosis 1 |
| 121918727 | TGM1 | NM_000359.2(TGM1): c.857G>A (p.Arg286Gln) | GGTGAGCRGACCTGGAACTACGG | Autosomal recessive congenital ichthyosis 1 |
| 398122904 | TGM1 | NM_000359.2(TGM1): c.2278C>T (p.Arg760Ter) | CCAGTCGTTTGTGCCTGTGYGAC | Autosomal recessive congenital ichthyosis 1 |
| 372250159 | TGM6 | NM_198994.2(TGM6): c.331C>T (p.Arg111Cys) | CCCAGTGCTGTCATTGGCYGCTA, CCAGTGCTGTCATTGGCYGCTAC | Spinocerebellar ataxia 35 |
| 121917764 | TH | NM_199292.2(TH): c.941C>T (p.Thr314Met) | CCCCTTGCAGAGCGCAYGGGCTT, CCCTTGCAGAGCGCAYGGGCTTC, CCTTGCAGAGCGCAYGGGCTTCC | Segawa syndrome, autosomal recessive |
| 121918694 | THRB | NM_001128177.1(THRB): c.700G>A (p.Ala234Thr) | CCAACRCCCAAGGCAGCCACTGG | Thyroid hormone resistance, generalized, autosomal dominant |
| 121918698 | THRB | NM_001128177.1(THRB): c.1313G>A (p.Arg438His) | CAGCCRCTTCCTGCACATGAAGG | Thyroid hormone resistance, generalized, autosomal dominant |
| 121918696 | THRB | NM_001128177.1(THRB): c.958C>T (p.Arg320Cys) | CCCTTCGCGCTGCTGTGYGCTAT, CCTTCGCGCTGCTGTGYGCTATG | Thyroid hormone resistance, generalized, autosomal dominant |
| 121918707 | THRB | NM_001128177.1(THRB): c.727C>T (p.Arg243Trp) | CCACTGGAAGCAAAAAYGGAAAT | Thyroid hormone resistance, generalized, autosomal dominant |
| 1054894 | TIMM8A | NM_004085.3(TIMM8A): c.238C>T (p.Arg80Ter) | CCAGTTCATCTTGAATYGACTGG | Mohr-Tranebjaerg syndrome |
| 80356559 | TIMM8A | NM_004085.3(TIMM8A): c.112C>T (p.Gln38Ter) | CCAGCAGCTGGTGCACYAGATGA | Mohr-Tranebjaerg syndrome |
| 199422321 | TINF2 | NM_001099274.1(TINF2): c.706C>T (p.Pro236Ser) | CCCCTGCCAAAAGCCAAGYCTGG, CCCTGCCAAAAGCCAAGYCTGGC, CCTGCCAAAAGCCAAGYCTGGCA | Dyskeratosis congenita, autosomal dominant |
| 387907154 | TINF2 | NM_001099274.1(TINF2): c.811C>T (p.Gln271Ter) | CCGACGAAGAGTTCAGTCCYAAT | Dyskeratosis congenita, autosomal dominant, 3 |
| 281865496 | TK2 | NM_004614.4(TK2): c.575G>A (p.Arg192Lys) | AGARGTTAAAGAAGAGATGCAGG | Mitochondrial DNA depletion syndrome 2 |
| 281865489 | TK2 | NM_004614.4(TK2): c.268C>T (p.Arg90Cys) | CCAAGTGGAGAAATGTCYGTGGC | Mitochondrial DNA depletion syndrome 2 |
| 281865493 | TK2 | NM_004614.4(TK2): c.388C>T (p.Arg130Trp) | CCTTTAGGTGTCATCTGTAYGGT | Mitochondrial DNA depletion syndrome 2 |
| 137854431 | TK2 | NM_004614.4(TK2): c.323C>T (p.Thr108Met) | CCTCTCGCTGGGGTCTTAYGCTA | Mitochondrial DNA depletion syndrome 2, not provided |
| 121908327 | TMC6 | NM_007267.6(TMC6): c.280C>T (p.Arg94Ter) | CCTCCATAGGCCGCAGCYGAGGT, CCATAGGCCGCAGCYGAGGTGCC | Epidermodysplasia verruciformis |
| 387907134 | TMEM138 | NM_016464.4(TMEM138): c.376G>A (p.Ala126Thr) | ACTARGTAAGGACCAGAGCAAGG | Joubert syndrome 16 |
| 387907133 | TMEM138 | NM_016464.4(TMEM138): c.380C>T (p.Ala127Val) | CCTCCCCACAGCAGYAGTGTTGT | Joubert syndrome 16 |
| 387907221 | TMEM165 | NM_018475.4(TMEM165): c.377G>A (p.Arg126His) | AACCRCCTGACCGTGCTGGCTGG, CTATAACCRCCTGACCGTGCTGG | Congenital disorder of glycosylation type 2k |
| 587777610 | TMEM173 | NM_198282.3(TMEM173): c.463G>A (p.Val155Met) | CCAGCCCATGGGCCAYGTTGAAA | Sting-associated vasculopathy, infantile-onset |
| 199469707 | TMEM237 | NM_001044385.2(TMEM237): c.52C>T (p.Arg18Ter) | CCGCCACAGCGTCCTCCAYGAGC, CCACAGCGTCCTCCAYGAGCTCT | Familial aplasia of the vermis, Joubert syndrome 14 |
| 606231454 | TMEM240 | NM_001114748.1(TMEM240): c.239C>T (p.Thr80Met) | CCGAGAACTACTTTGTGAYGGAC | Spinocerebellar ataxia 21 |
| 606231453 | TMEM240 | NM_001114748.1(TMEM240): c.346C>T (p.Arg116Cys) | CCTGCACTGCGCCGTGYGCGCCT | Spinocerebellar ataxia 21 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 63750743 | TMEM43 | NM_024334.2(TMEM43): 1073C>T (p.Ser358Leu) | CCTTCTGTGTGGCCACCTYGCTG | Arrhythmogenic right ventricular cardiomyopathy, Arrhythmogenic right ventricular cardiomyopathy, type 5, not provided |
| 267607114 | TMEM67 | NM_001142301.1(TMEM67): c.1391G>A (p.Gly464Glu) | CAGRATGGAAGAGGCGCATTGGG, GCAGRATGGAAGAGGCGCATTGG | Joubert syndrome 6 |
| 267607118 | TMEM67 | NM_153704.5(TMEM67): c.130C>T (p.Gln44Ter) | CCTTCTCTTTCCCTTTCYAGCAG | Joubert syndrome 6 |
| 28941781 | TMIE | NM_147196.2(TMIE): c.274C>T (p.Arg92Trp) | CCGGAAGGAGATCGAAGCCYGGT | Deafness, autosomal recessive 6 |
| 121908059 | TMPRSS15 | NM_002772.2(TMPRSS15): c.2569C>T (p.Arg857Ter) | CCTCAAACAGTCCCTYGATTAAT | Enterokinase deficiency |
| 181949335 | TMPRSS3 | NM_024022.2(TMPRSS3): c.916G>A (p.Ala306Thr) | CCGGCCAGCTTCATAAGGYGAT, CCAGCTTCATAAGGGYGATGTCA | Deafness, autosomal recessive 8 |
| 374793617 | TMPRSS3 | NM_024022.2(TMPRSS3): c.323-6G>A | CCACCCACCCGGACTGGCYGATG, CCCACCCGGACTGGCYGATGTGC, CCACCCGGACTGGCYGATGTGCA | Deafness, autosomal recessive 8 |
| 137853119 | TMPRSS6 | NM_153609.3(TMPRSS6): c.1324G>A (p.Gly442Arg) | CCTCACCRGGCCCGGTGTGCGGG, CCCTCACCRGGCCCGGTGTGCGG | Microcytic anemia |
| 137853120 | TMPRSS6 | NM_153609.3(TMPRSS6): c.1561G>A (p.Asp521Asn) | CAGCRACGAAGAGCAGTGCCAGG | Microcytic anemia |
| 387907018 | TMPRSS6 | NM_153609.3(TMPRSS6): c.1564G>A (p.Glu522Lys) | GACRAAGAGCAGTGCCAGGAAGG, CAGCGACRAAGAGCAGTGCCAGG | Microcytic anemia |
| 137853123 | TMPRSS6 | NM_153609.3(TMPRSS6): c.1795C>T (p.Arg599Ter) | CCTCCAGGTTCGGGGTYGACACA | Microcytic anemia |
| 281865419 | TNF | NM_000594.3(TNF): c.322C>T (p.Arg108Trp) | CCAGTGGCTGAACCGCYGGGCCA | |
| 104895222 | TNFRSF1A | NM_001065.3(TNFRSF1A): c.350G>A (p.Cys117Tyr) | CTCTTCTTRCACAGTGGACCGGG | TNF receptor-associated periodic fever syndrome (TRAPS) |
| 104895218 | TNFRSF1A | NM_001065.3(TNFRSF1A): c.185G>A (p.Cys62Tyr) | ACCAAGTRCCACAAAGGTAGGGG, TACCAAGTRCCACAAAGGTAGGG | TNF receptor-associated periodic fever syndrome (TRAPS) |
| 587777075 | TNFRSF4 | NM_003327.3(TNFRSF4): c.193C>T (p.Arg65Cys) | CGGACRGCACACCGTGTTCTGGG, ACGGACRGCACACCGTGTTCTGG | Immunodeficiency 16 |
| 104894312 | TNNI2 | NM_003282.3(TNNI2): c.466C>T (p.Arg156Ter) | CCACAGGAGCGGGACCTYGAGA | Distal arthrogryposis type 2B, not provided |
| 727503503 | TNNI3 | NM_000363.4(TNNI3): c.509G>A (p.Arg170Gln) | CCTGCRGGCCCACCTCAAGCAGG | Familial restrictive cardiomyopathy 1, Cardiomyopathy, Familial hypertrophic cardiomyopathy 7 |
| 397516355 | TNNI3 | NM_000363.4(TNNI3): c.544G>A (p.Glu182Lys) | GACACCRAGAAGGTGAGTGTGGG, GGACACCRAGAAGGTGAGTGTGG | Dilated cardiomyopathy 1FF, Cardiomyopathy |
| 397516357 | TNNI3 | NM_000363.4(TNNI3): c.557G>A (p.Arg186Gln) | AAAACCRGGAGGTGGGAGACTGG | Primary familial hypertrophic cardiomyopathy, Cardiomyopathy, Hypertrophic cardiomyopathy, Familial hypertrophic cardiomyopathy 7 |
| 121917761 | TNNI3 | NM_000363.4(TNNI3): c.511G>A (p.Ala171Thr) | CCTGCRGGCCCACCTCAAGCAGG | Familial restrictive cardiomyopathy 1, not specified |
| 730881069 | TNNI3 | NM_000363.4(TNNI3): c.407G>A (p.Arg136Gln) | ACCTTCRAGGCAAGTTTAAGCGG | Cardiomyopathy, Hypertrophic cardiomyopathy |
| 727504242 | TNNI3 | NM_000363.4(TNNI3): c.497C>T (p.Ser166Phe) | CCCGGGCTAAGGAGTYCCTGGAC, CCGGGCTAAGGAGTYCCTGGACC | Cardiomyopathy, not specified |
| 267607128 | TNNI3 | NM_000363.4(TNNI3): c.61C>T (p.Arg21Cys) | CCAGCCCAATCAGAYGCCGCTC | Familial hypertrophic cardiomyopathy 7 |
| 727504247 | TNNT2 | NM_001001430.2(TNNT2): c.860G>A (p.Trp287Ter) | CGGGCGCTRGAAATAGAGCCTGG | Familial hypertrophic cardiomyopathy 2, Cardiomyopathy |
| 121964856 | TNNT2 | NM_001001430.2(TNNT2): c.275G>A (p.Arg92Gln) | CCACCRGAAGCGCATGGAGAAGG | Familial hypertrophic cardiomyopathy 2, Cardiomyopathy |
| 45501500 | TNNT2 | NM_001001430.2(TNNT2): c.476G>A (p.Arg159Gln) | GACRAGAGGAGGAGAACAGG | Cardiomyopathy, not specified |
| 730881101 | TNNT2 | NM_001001430.2(TNNT2): c.422G>A (p.Arg141Gln) | CATCCRGAATGAGCGGGAGAAGG | Cardiomyopathy |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121964857 | TNNT2 | NM_000364.3(TNNT2): c.853C>T (p.Arg285Cys) | CCCCTGCAGCTCCAAGACCYGCG, CCCTGCAGCTCCAAGACCYGCGG, CCTGCAGCTCCAAGACCYGCGGG | Costello syndrome, Primary familial hypertrophic cardiomyopathy, Familial hypertrophic cardiomyopathy 2, Familial hypertrophic cardiomyopathy 1, Cardiomyopathy, not specified |
| 397516456 | TNNT2 | NM_001001430.2(TNNT2): c.274C>T (p.Arg92Trp) | CCACCCACAGGACATCCACYGGA, CCCACAGGACATCCACYGGAAGC, CCACAGGACATCCACYGGAAGCG | Familial hypertrophic cardiomyopathy 2, Cardiomyopathy |
| 727504245 | TNNT2 | NM_001001430.2(TNNT2): c.311C>T (p.Ala104Val) | CCTGAATGAGTTGCAGGYGCTGA | Familial hypertrophic cardiomyopathy 2, Cardiomyopathy, not specified |
| 74315380 | TNNT2 | NM_001001430.2(TNNT2): c.391C>T (p.Arg131Trp) | CCTTAGGAGAGACGTYGGGCAGA | Primary dilated cardiomyopathy, Left ventricular noncompaction 6, Cardiomyopathy |
| 587777682 | TNXB | NM_019105.6(TNXB): c.12214C>T (p.Arg4072Cys) | CATGCGGCRCTGGAACACCTGGG | Ehlers-Danlos-like syndrome due to tenascin-X deficiency |
| 587777684 | TNXB | NM_019105.6(TNXB): c.3991G>A (p.Gly1331Arg) | CCTGCCACGAAGCCYGTAGAGGT | Vesicoureteral reflux 8 |
| 121912652 | TP53 | NM_000546.5(TP53): c.772G>A (p.Glu258Lys) | ACACTGRAAGACTCCAGGTCAGG | Li-Fraumeni syndrome 1, Hereditary cancer-predisposing syndrome |
| 587778720 | TP53 | NM_000546.5(TP53): c.638G>A (p.Arg213Gln) | CACTTTTCRACATAGTGTGGTGG | Li-Fraumeni syndrome, Li-Fraumeni syndrome 1, Hereditary cancer-predisposing syndrome, not specified |
| 587781288 | TP53 | NM_000546.5(TP53): c.422G>A (p.Cys141Tyr) | GACCTRCCCTGTGCAGCTGTGGG, AGACCTRCCCTGTGCAGCTGTGG | Hereditary cancer-predisposing syndrome |
| 121913344 | TP53 | NM_000546.5(TP53): c.916C>T (p.Arg306Ter) | CCCCAGGGAGCACTAAGYGAGG, CCCAGGGAGCACTAAGYGAGGT, CCAGGGAGCACTAAGYGAGGTAA | Hereditary cancer-predisposing syndrome |
| 397516435 | TP53 | NM_000546.5(TP53): c.586C>T (p.Arg196Ter) | CCCTCCTCAGCATCTTATCYGAG, CCTCCTCAGCATCTTATCYGAGT, CCTCAGCATCTTATCYGAGTGGA | Li-Fraumeni syndrome 1, Hereditary cancer-predisposing syndrome |
| 587780071 | TP53 | NM_000546.5(TP53): c.580C>T (p.Leu194Phe) | CCCCTCCTCAGCATYTTATCCGA | Hereditary cancer-predisposing syndrome |
| 730882001 | TP53 | NM_000546.5(TP53): c.493C>T (p.Gln165Ter) | CCATGGCCATCTACAAGYAGTCA | Hereditary cancer-predisposing syndrome |
| 121908841 | TP63 | NM_003722.4(TP63): c.1028G>A (p.Arg343Gln) | GCCCRGATCTGTGCTTGCCCAGG | Ectrodactyly, ectodermal dysplasia, and cleft lip/palate syndrome 3 |
| 113993967 | TP63 | NM_003722.4(TP63): c.1010G>A (p.Arg337Gln) | GCCRACGCTGCTTTGAGGCCCGG, CCTGGGCCRACGCTGCTTTGAGG | ADULT syndrome |
| 121964846 | TPI1 | NM_001159287.1(TPI1): c.478G>A (p.Gly160Arg) | CTCRGAGTAATCGCCTGCATTGG | |
| 104894503 | TPM1 | NM_001018005.1(TPM1): c.523G>A (p.Asp175Asn) | GAGCRACCTGGAACGTGCAGAGG | Primary familial hypertrophic cardiomyopathy, Familial hypertrophic cardiomyopathy 3, Sudden cardiac death, Cardiomyopathy |
| 397516382 | TPM1 | NM_001018005.1(TPM1): c.64G>A (p.Ala22Thr) | GGATCGARCTGAGCAGGCGGAGG | Cardiomyopathy, not specified |
| 199476317 | TPM1 | NM_001018005.1(TPM1): c.688G>A (p.Asp230Asn) | CCTTTCCRACAAGCTGAAGGAGG | Dilated cardiomyopathy 1Y, Cardiomyopathy, not provided |
| 199474717 | TPM3 | NM_152263.3(TPM3): c.721G>A (p.Glu241Lys) | TGCTRAGTTTGCTGAGAGATCGG | Congenital myopathy with fiber type disproportion, not provided |
| 199474711 | TPM3 | NM_152263.3(TPM3): c.11C>T (p.Ala4Val) | CCACTGCTCATGATGGAGGYCAT | Congenital myopathy with fiber type disproportion, not provided |
| 121908195 | TPP1 | NM_000391.3(TPP1): c.229G>A (p.Gly77Arg) | TACRGTGCCTTTTGGGACTGAGG | Ceroid lipofuscinosis, neuronal, 2 |
| 119455954 | TPP1 | NM_000391.3(TPP1): c.1094G>A (p.Cys365Tyr) | GCCGGGTRTTGGTCTGTCTCTGG | Ceroid lipofuscinosis, neuronal, 2, not provided |
| 119455956 | TPP1 | NM_000391.3(TPP1): c.1340G>A (p.Arg447His) | TGGCCRTGCCTACCCAGATGTGG | Ceroid lipofuscinosis, neuronal, 2, not provided |
| 119455955 | TPP1 | NM_000391.3(TPP1): c.622C>T (p.Arg208Ter) | CCCCTCTGTGATCCGTAAGYGAT, CCCTCTGTGATCCGTAAGYGATA, CCTCTGTGATCCGTAAGYGATAC | Ceroid lipofuscinosis, neuronal, 2, not provided |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28940573 | TPP1 | NM_000391.3(TPP1): c.616C>T (p.Arg206Cys) | CCCCCTCTGTGATCYGTAAGCGA | Ceroid lipofuscinosis, neuronal, 2 |
| 104894001 | TREM2 | NM_018965.3(TREM2): c.132G>A (p.Trp44Ter) | ACTGRGGGAGGCGCAAGGCCTGG | Polycystic lipomembranous osteodysplasia with sclerosing leukoencephalopathy |
| 121908117 | TREX1 | NM_016381.5(TREX1): c.217G>A (p.Asp73Asn) | TTTTTCRACATGGAGGCCACTGG | Aicardi Goutieres syndrome 1, Aicardi Goutieres syndrome 1, autosomal dominant, Chilbain lupus 1 |
| 121917847 | TRHR | NM_003301.5(TRHR): c.49C>T (p.Arg17Ter) | CCAAACACAGCTTCAGCCAYGAG | Thyrotropin-releasing hormone resistance, generalized |
| 118204027 | TRIOBP | NM_001039141.2(TRIOBP): c.1741C>T (p.Gln581Ter) | CCCCAGAACATCCTGTGCCYAGC, CCCAGAACATCCTGTGCCYAGCG, CCAGAACATCCTGTGCCYAGCGG | Deafness, autosomal recessive 28 |
| 118204028 | TRIOBP | NM_001039141.2(TRIOBP): c.889C>T (p.Gln297Ter) | CCTCATCCACCCAAYAGGAAATC | Deafness, autosomal recessive 28 |
| 118204031 | TRIOBP | NM_001039141.2(TRIOBP): c.3349C>T (p.Arg1117Ter) | CCTGTGTGTATTGGGTACYGAGA | Deafness, autosomal recessive 28 |
| 118204029 | TRIOBP | NM_001039141.2(TRIOBP): c.2362C>T (p.Arg788Ter) | CCCAATAGAGCCACAYGAGACAA, CCAATAGAGCCACAYGAGACAAC | Deafness, autosomal recessive 28 |
| 118203991 | TRMU | NM_018006.4(TRMU): c.815G>A (p.Gly272Asp) | TAGGTGRCCTGAGAGAGCCCTGG | Liver failure acute infantile |
| 369742878 | TRPM1 | NM_002420.5(TRPM1): c.2998C>T (p.Arg1000Ter) | TTTCRGGCCAGTTTCCAAGAGGG, GTTTCRGGCCAGTTTCCAAGAGG | Congenital stationary night blindness, type 1C, not provided |
| 201907325 | TRPM4 | NM_017636.3(TRPM4): c.1294G>A (p.Ala432Thr) | TGGACRCCCTGCTGAATGACCGG | Progressive familial heart block type 1B |
| 267607142 | TRPM4 | NM_017636.3(TRPM4): c.19G>A (p.Glu7Lys) | GAGAAGRAGCAGGTGAGCGCCGG | Progressive familial heart block type 1B |
| 121912625 | TRPM6 | NM_017662.4(TRPM6): c.422C>T (p.Ser141Leu) | CCCAAGCTTGTGATCTYAGTCCA, CCAAGCTTGTGATCTYAGTCCAT | Hypomagnesemia 1, intestinal |
| 28939070 | TRPS1 | NM_014112.4(TRPS1): c.2894G>A (p.Arg965His) | AAGAAAGCRCCTTAACCCAGAGG | Trichorhinophalangeal dysplasia type I |
| 121908435 | TRPS1 | NM_014112.4(TRPS1): c.2762G>A (p.Arg921Gln) | TGGCRAAAGAATGCAAATGGCGG, CTCTGGCRAAAGAATGCAAATGG | Trichorhinophalangeal syndrome type 3 |
| 121908432 | TRPS1 | NM_014112.4(TRPS1): c.2557C>T (p.Arg853Ter) | CCGCCCATCTGGCGYGACCTATT | Trichorhinophalangeal dysplasia type I |
| 397514494 | TRPV4 | NM_021625.4(TRPV4): c.557G>A (p.Arg186Gln) | TTCRAGGTGAGCCACCCAGATGG | Charcot-Marie-Tooth disease type 2C, Distal spinal muscularatrophy, congenital nonprogressive |
| 77975504 | TRPV4 | NM_021625.4(TRPV4): c.1781G>A (p.Arg594His) | CCCRTGGGCTGAAGCTGACGGGG, ACCCRTGGGCTGAAGCTGACGGG, CACCCRTGGGCTGAAGCTGACGG | Spondylometaphyseal dysplasia, Kozlowski type, Parastremmatic dwarfism |
| 387906905 | TRPV4 | NM_021625.4(TRPV4): c.947G>A (p.Arg316His) | ATGCGGCRCCAGGACTCGCGAGG | Charcot-Marie-Tooth disease type 2C |
| 267607143 | TRPV4 | NM_021625.4(TRPV4): c.943C>T (p.Arg315Trp) | CCACAAGAAGGCGGACATGYGGC | Charcot-Marie-Tooth disease type 2C, Charcot-Marie-Tooth disease, Scapuloperoneal spinal muscular atrophy, Distal spinal muscular atrophy, congenital nonprogressive |
| 387906906 | TRPV4 | NM_021625.4(TRPV4): c.2219C>T (p.Thr740Ile) | CCCCGCAGTGGGCCACCAYCATC, CCCGCAGTGGGCCACCAYCATCC, CCGCAGTGGGCCACCAYCATCCT | Metatrophic dysplasia |
| 118203387 | TSC1 | NM_000368.4(TSC1): c.491G>A (p.Trp164Ter) | TCATRGTGCCTGAAGAAACCAGG | Tuberous sclerosis syndrome, Lymphangiomyomatosis, not provided |
| 118203427 | TSC1 | NM_000368.4(TSC1): c.682C>T (p.Arg228Ter) | CCAATGATGGAGCATGTGYGAAT | Tuberous sclerosis syndrome, Tuberous sclerosis 1, not provided |
| 28934872 | TSC2 | NM_000548.3(TSC2): c.1832G>A (p.Arg611Gln) | GCATCCRGCTGCAGGTATGGTGG | Tuberous sclerosis syndrome, Lymphangiomyomatosis, Tuberous sclerosis 2 |
| 45515894 | TSC2 | NM_000548.3(TSC2): c.1322G>A (p.Trp441Ter) | CGGCTRGATTCAGAACCTGCAGG | Tuberous sclerosis syndrome, Tuberous sclerosis 2 |
| 45517150 | TSC2 | NM_000548.3(TSC2): c.976-15G>A | GCTGGCCRGGCTCGTGTTCCAGG | Tuberous sclerosis syndrome, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 45466296 | TSC2 | NM_000548.3(TSC2): c.848+1G>A | ACAGRTGAGTGTGGTGGGTGGGG, GACAGRTGAGTGTGGTGGGTGGG, GGACAGRTGAGTGTGGTGGGTGG | Tuberous sclerosis syndrome, Tuberous sclerosis 2, not provided |
| 45483392 | TSC2 | NM_000548.3(TSC2): c.5024C>T (p.Pro1675Leu) | CCACGTGATCGTCACCCYGCTGG | Tuberous sclerosis syndrome, Lymphangiomyomatosis, Tuberous sclerosis 2 |
| 45517340 | TSC2 | NM_000548.3(TSC2): c.4375C>T (p.Arg1459Ter) | CCCAGTGGCCTCCGGCCCYGAGG, CCAGTGGCCTCCGGCCCYGAGGT | Tuberous sclerosis syndrome, Tuberous sclerosis 2, not provided |
| 113994153 | TSEN54 | NM_207346.2(TSEN54): c.736C>T (p.Gln246Ter) | CCCAGAGGAGAAACCCYAGGAGT, CCAGAGGAGAAACCCYAGGAGTC | Pontocerebellar hypoplasia type 4 |
| 587777688 | TSFM | NM_005726.5(TSFM): c.944G>A (p.Cys315Tyr) | TGAATRTGGAGAAGGTGAAGAGG | Combined oxidative phosphorylation deficiency 3 |
| 121918668 | TSHB | NM_000549.4(TSHB): c.145G>A (p.Gly49Arg) | TGCTRGATATTGTATGACACGGG, GTGCTRGATATTGTATGACACGG | Secondary hypothyroidism |
| 121918670 | TSHB | NM_000549.4(TSHB): c.205C>T (p.Gln69Ter) | CCCAAATATGCTCTGTCCYAGGA, CCAAATATGCTCTGTCCYAGGAT | Secondary hypothyroidism |
| 121908881 | TSHR | NM_000369.2(TSHR): c.1430C>T (p.Thr477Ile) | CCTCTGTAGACCTACAYTCAC | Hypothyroidism, congenital, nongoitrous, 1 |
| 387907094 | TTC19 | NM_017775.3(TTC19): c.517C>T (p.Gln173Ter) | CCTTGGAGGGGGCATGAAGYAGG | Mitochondrial complex III deficiency, nuclear type 2 |
| 786205698 | TTC7A | NM_001288953.1(TTC7A): c.1474C>T (p.Gln492Ter) | CCCCACACAGGGCTCAGYAGCTG, CCCACACAGGGCTCAGYAGCTGG, CCACACAGGGCTCAGYAGCTGGC | Multiple gastrointestinal atresias |
| 138060032 | TTN | NM_001256850.1(TTN): c.835C>T (p.Arg279Trp) | CTGCCRAGCCAGCTGTGCTTTGG | Hereditary myopathy with early respiratory failure, not provided |
| 372277017 | TTN | NM_133378.4(TTN): c.12064C>T (p.Arg4022Ter) | GCTCRCTCAATGATTTTGGCAGG, TTCTGCTCRCTCAATGATTTTGG | Distal myopathy Markesbery-Griggs type |
| 397515524 | TTPA | NM_000370.3(TTPA): c.421G>A (p.Glu141Lys) | ATCCRAGCTTATTGTACAGGAGG, CACATCCRAGCTTATTGTACAGG | Ataxia with vitamin E deficiency |
| 76992529 | TTR | NM_000371.3(TTR): c.424G>A (p.Val142Ile) | GGCTGTCRTCACCAATCCCAAGG | Amyloidogenic transthyretin amyloidosis, Amyloid Cardiomyopathy, Transthyretin-related, Cardiomyopathy, not provided |
| 121918086 | TTR | NM_000371.3(TTR): c.241G>A (p.Glu81Lys) | ACTRAGGAGGAATTTGTAGAAGG | Amyloidogenic transthyretin amyloidosis |
| 753719501 | TUBA1A | NM_006009.3(TUBA1A): c.1224C>A (p.Tyr408Ter) | CCCAACRTACCAGTGAACAAAGG | Lissencephaly 3 |
| 137853043 | TUBA1A | NM_006009.3(TUBA1A): c.790C>T (p.Arg264Cys) | CCTGGTGCCCTATCCCYGCATCC | Lissencephaly 3 |
| 730880027 | TUBA4A | NM_006000.2(TUBA4A): c.1220G>A (p.Trp407Ter) | GTGCACTRGTATGTGGGTGAGGG, TGTGCACTRGTATGTGGGTGAGG | Amyotrophic lateral sclerosis 22 with or without frontotemporal dementia |
| 368743618 | TUBA4A | NM_006000.2(TUBA4A): c.1147G>A (p.Ala383Thr) | CCCAGGCCTCGGCGATGGYGGTC, CCAGGCCTCGGCGATGGYGGTCG | Amyotrophic lateral sclerosis 22 with or without frontotemporal dementia |
| 730880025 | TUBA4A | NM_006000.2(TUBA4A): c.958C>T (p.Arg320Cys) | CCTGCTGCCTGCTGTACYGTGGA | Amyotrophic lateral sclerosis 22 with or without frontotemporal dementia |
| 587777357 | TUBB | NM_178014.3(TUBB): c.1201G>A (p.Glu401Lys) | AGGCRAGGGCATGGACGAGATGG | Cortical dysplasia, complex, with other brain malformations 6 |
| 587777324 | TUBB2A | NM_001069.2(TUBB2A): c.743C>T (p.Ala248Val) | GGTCTRCGTTCAGCTGGCCCGGG, AGGTCTRCGTTCAGCTGGCCCGG | Cortical dysplasia, complex, with other brain malformations 5 |
| 398122369 | TUBB2B | NM_178012.4(TUBB2B): c.1261G>A (p.Glu421Lys) | GTCCRAGTACCAGCAGTACCAGG | Polymicrogyria, asymmetric |
| 267607163 | TUBB3 | NM_001197181.1(TUBB3): c.688G>A (p.Ala230Thr) | GCCRCCTGCGACCCGCGCCACGG | Fibrosis of extraocular muscles, congenital, 3a, with or without extraocular involvement |
| 483352809 | TUBB4A | NM_006087.3(TUBB4A): c.745G>A (p.Asp249Asn) | GAACGCCRACCTGCGCAAGCTGG | Leukodystrophy, hypomyelinating, 6 |
| 587777074 | TUBB4A | NM_001289123.1(TUBB4A): c.964G>A (p.Ala322Thr) | CCCCGGCTGGTCAGGGGTGYGAA, CCCGGCTGGTCAGGGGTGYGAAG, CCGGCTGGTCAGGGGTGYGAAGC | Autosomal dominant torsion dystonia 4 |
| 121434452 | TUFM | NM_003321.4(TUFM): c.1016G>A (p.Arg339Gln) | CTTGCGGCRGGGCCTGGTCATGG | Combined oxidative phosphorylation deficiency 4 |
| 121909077 | TULP1 | NM_003322.4(TULP1): c.1444C>T (p.Arg482Trp) | CCCTCAACTTCCAAGGCYGGGTC, CCTCAACTTCCAAGGCYGGGTCA | Retinitis pigmentosa 14 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909190 | TWIST1 | NM_000474.3(TWIST1): c.556G>A (p.Ala186Thr) | GCTACRCCTTCTCGGTCTGGAGG, TCAGCTACRCCTTCTCGGTCTGG | Craniosynostosis 1 |
| 104894065 | TWIST1 | NM_000474.3(TWIST1): c.211C>T (p.Gln71Ter) | CCGGGCAGCCCGGCCYAGGGCAA | Robinow Sorauf syndrome |
| 387906974 | TWIST2 | NM_057179.2(TWIST2): c.193C>T (p.Gln65Ter) | CCTTCGAGGAGCTGYAGAGCCAG | Congenital ectodermal dysplasia of face |
| 727502794 | TXNL4A | NM_001305563.1(TXNL4A): c.-60-10655C>T | CCTGCACAACGGCTGGYAGGTGG | Burn-Mckeown syndrome |
| 121913037 | TYMP | NM_001113755.2(TYMP): c.433G>A (p.Gly145Arg) | TGATCAGCRGACGTGGTCTGGGG | |
| 121913038 | TYMP | NM_001113755.2(TYMP): c.457G>A (p.Gly153Ser) | AGGARGCACCTTGGATAAGCTGG | |
| 28940880 | TYR | NM_000372.4(TYR): c.616G>A (p.Ala206Thr) | AAGCACCARCTTTTCTGCCTTGG | Tyrosinase-negative oculocutaneous albinism, not provided |
| 61753180 | TYR | NM_000372.4(TYR): c.140G>A (p.Gly47Asp) | TGTGRCCAGCTTTCAGGCAGAGG | Tyrosinase-negative oculocutaneous albinism, Oculocutaneous albinism type 1B, not provided |
| 137854890 | TYR | NM_000372.4(TYR): c.272G>A (p.Cys91Tyr) | CAGTRCTCTGGCAACTTCATGGG, CCAGTRCTCTGGCAACTTCATGG | Tyrosinase-negative oculocutaneous albinism |
| 28940876 | TYR | NM_000372.4(TYR): c.242C>T (p.Pro81Leu) | CCGGGAGTCGTGGCYTTCCGTCT | Tyrosinase-negative oculocutaneous albinism, Oculocutaneous albinism type 1B, not provided |
| 61753178 | TYR | NM_000372.4(TYR): c.61C>T (p.Pro21Ser) | CCTCCGCTGGCCATTTCYCTAGA, CCGCTGGCCATTTCYCTAGAGCC | Tyrosinase-negative oculocutaneous albinism, not provided |
| 104894313 | TYR | NM_000372.4(TYR): c.1217C>T (p.Pro406Leu) | CCGAAGGCACCGTCYTCTTCAAG | Oculocutaneous albinism type 1B, not provided |
| 80356547 | UBA1 | NM_003334.3(UBA1): c.1731C>T (p.Asn577=) | CCAATGCCCTGGACAAYGTGGAT | Arthrogryposis multiplex congenita, distal, X-linked |
| 387906710 | UBQLN2 | NM_013444.3(UBQLN2): c.1489C>T (p.Pro497Ser) | CCCTGTAGGCCCAGTCACCYCCA, CCTGTAGGCCCAGTCACCYCCAT | Amyotrophic lateral sclerosis 15, with or without frontotemporal dementia |
| 387906712 | UBQLN2 | NM_013444.3(UBQLN2): c.1525C>T (p.Pro509Ser) | CCCTATAGTCCCTTTTACCYCCA, CCTATAGTCCCTTTTACCYCCAT | Amyotrophic lateral sclerosis 15, with or without frontotemporal dementia |
| 17848368 | UCP3 | NM_003356.3(UCP3): c.208C>T (p.Arg70Trp) | CCATCCTGACCATGGTGYGGACT | |
| 28934582 | UMOD | NM_003361.3(UMOD): c.443G>A (p.Cys148Tyr) | TGGCACTRTGAGTGCTCCCCGGG, ATGGCACTRTGAGTGCTCCCCGG | Familial juvenile gout |
| 398123698 | UMOD | NM_003361.3(UMOD): c.944G>A (p.Cys315Tyr) | ATGGCACTRCCAGTGCAAACAGG | not provided |
| 777759523 | UNC13D | NM_199242.2(UNC13D): c.1389+1G>A | CCCCAGCGCGAGTACCATAYCTG, CCCAGCGCGAGTACCATAYCTGC, CCCAGCGCGAGTACCATAYCTGCA | Hemophagocytic lymphohistiocytosis, familial, 3 |
| 11544803 | UQCRQ | NM_014402.4(UQCRQ): c.134C>T (p.Ser45Phe) | CCGCATTCGGGAGTYTTTCTTTC | Mitochondrial complex III deficiency, nuclear type 4 |
| 137852795 | UROC1 | NM_001165974.1(UROC1): c.1528C>T (p.Arg510Cys) | CCAGGGATTTGGGCCTTTCYGCT | Urocanate hydratase deficiency |
| 121918066 | UROD | NM_000374.4(UROD): c.995G>A (p.Arg332His) | CATCRCTACATTGCCAACCTGGG, ACATCRCTACATTGCCAACCTGG | Familial porphyria cutanea tarda |
| 397514765 | UROD | NM_000374.4(UROD): c.346C>T (p.Gln116Ter) | CCATTAAGAGAAGAGYAGGACCT | Porphyria cutanea tarda |
| 121918064 | UROD | NM_000374.4(UROD): c.583C>T (p.Leu195Phe) | CCAGCTGCTTCGCATCYTCACTG | Familial porphyria cutanea tarda |
| 397515349 | UROS | NM_000375.2(UROS): c.-26-183G>A | CTTGRCCTTATCAGTGACAGGGG, TCTTGRCCTTATCAGTGACAGGG, TTCTTGRCCTTATCAGTGACAGG | Congenital erythropoietic porphyria |
| 121908014 | UROS | NM_000375.2(UROS): c.683C>T (p.Thr228Met) | CCATCGGCCCCACTAYGGCTCGC | Congenital erythropoietic porphyria |
| 121908015 | UROS | NM_000375.2(UROS): c.10C>T (p.Leu4Phe) | CCAGGCAATAATGAAGGTTYTTT | Congenital erythropoietic porphyria |
| 104894652 | USH1G | NM_173477.4(USH1G): c.113G>A (p.Trp38Ter) | ACTCTCTRGGCTGCCTACCATGG | Usher syndrome, type 1G |
| 397517974 | USH2A | NM_206933.2(USH2A): c.1143+1G>A | TCAGRTAATGAGAAACGATAAGG | Usher syndrome, type 2A |
| 111033386 | USH2A | NM_206933.2(USH2A): c.6224G>A (p.Trp2075Ter) | CTCCTRGAACCCACCCAAAAAGG | Usher syndrome, type 2A |
| 121912599 | USH2A | NM_206933.2(USH2A): c.956G>A (p.Cys319Tyr) | TACTRCATTCCTAATGATGCAGG | Usher syndrome, type 2A |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 146733615 | USH2A | NM_206933.2(USH2A): c.14803C>T (p.Arg4935Ter) | CTCRGTACTGAGGCACTGTGGGG, GCTCRGTACTGAGGCACTGTGGG, GGCTCRGTACTGAGGCACTGTGG | Usher syndrome, type 2A, Retinitis pigmentosa 39 |
| 397517983 | USH2A | NM_206933.2(USH2A): c.12868C>T (p.Gln4290Ter) | CCTGGATCCCACCAGAAYAGTCT | Usher syndrome, type 2A |
| 199605265 | USH2A | NM_206933.2(USH2A): c.12575G>A ) (p.Arg4192His | CCCTCGAAGCATCTGYGAATCAC, CCTCGAAGCATCTGYGAATCACT | Retinitis pigmentosa 39, not specified |
| 727504867 | USH2A | NM_206933.2(USH2A): c.14248C>T (p.Gln4750Ter) | CCATGTGATCTCTTCTACCYAAG | Usher syndrome, type 2A |
| 121918218 | VANGL1 | NM_138959.2(VANGL1): c.715G>A (p.Val239Ile) | CCATCRTCCTGCTGGAGCTCAGG | Caudal regression syndrome |
| 121909791 | VDR | NM_001017535.1(VDR): c.218G>A (p.Arg73Gln) | GGACAACCRACGCCACTGCCAGG | Vitamin D-dependent rickets, type 2 |
| 121909793 | VDR | NM_001017535.1(VDR): c.239G>A (p.Arg80Gln) | CTGCCRGCTCAAACGCTGTGTGG | Vitamin D-dependent rickets, type 2 |
| 121909794 | VDR | NM_001017535.1(VDR): c.149G>A (p.Arg50Gln) | CAGGCRAAGCATGAAGCGGAAGG | Vitamin D-dependent rickets, type 2 |
| 121909802 | VDR | NM_001017535.1(VDR): c.985G>A (p.Glu329Lys) | GGAGRAGCATGTCCTGCTCATGG | Vitamin D-dependent rickets, type 2 |
| 121909795 | VDR | NM_001017535.1(VDR): c.454C>T (p.Gln152Ter) | CCTACTCCGACTTCTGCYAGTTC | Vitamin D-dependent rickets, type 2 |
| 121909800 | VDR | NM_001017535.1(VDR): c.1171C>T (p.Arg391Cys) | CCAGAAGCTAGCCGACCTGYGCA | Vitamin D-dependent rickets, type 2 |
| 587777567 | VEGFC | NM_005429.4(VEGFC): c.628C>T (p.Arg210Ter) | GCATCRGCAGGAAGTGTGATTGG | Lymphedema, hereditary, id |
| 730882035 | VHL | NM_000551.3(VHL): c.482G>A (p.Arg161Gln) | AGCRATGCCTCCAGGTTGTCCGG | Hereditary cancer-predisposing syndrome |
| 730882034 | VHL | NM_000551.3(VHL): c.257C>T (p.Pro86Leu) | CCGCGCGTCGTGCTGCYCGTATG | Hereditary cancer-predisposing syndrome |
| 200370925 | VIPAS39 | NM_022067.3(VIPAS39): c.658C>T (p.Arg220Ter) | CCTGTCRCACCTCCAGCTCTCGG | Arthrogryposis, renal dysfunction, and cholestasis 2 |
| 180177366 | VPS13B | NM_017890.4(VPS13B): c.6732+1G>A | TACTACAGRTCTGTGGGTATTGG | Cohen syndrome, not provided |
| 180177356 | VPS13B | NM_017890.4(VPS13B): c.2074C>T (p.Arg692Ter) | CCTTTGCCATCCATTYGAATATT | Cohen syndrome, not provided |
| 180177370 | VPS13B | NM_017890.4(VPS13B): c.8318C>T (p.Ser2773Leu) | CCAAACAGAAATTGCCTTYGTAC | not provided |
| 121434383 | VPS33B | NM_018668.4(VPS33B): c.1594C>T (p.Arg532Ter) | CCCAGGTGCTAGAGCGGYGAAGC, CCAGGTGCTAGAGCGGYGAAGCT | Arthrogryposis renal dysfunction cholestasis syndrome |
| 61749398 | VWF | NM_000552.3(VWF): c.3970G>A (p.Gly1324Ser) | GACRGCTCCCACGCCTACATCGG | von Willebrand disease type 2M, not provided |
| 61749380 | VWF | NM_000552.3(VWF): c.3854C>T (p.Ser1285Phe) | CCTGCTGGATGGCTYCTCCAGGC | von Willebrand disease type 2M, not provided |
| 61751296 | VWF | NM_000552.3(VWF): c.7603C>T (p.Arg2535Ter) | CCTCATCAATGAGTGTGTCYGAG | von Willebrand disease type 3, not provided |
| 132630273 | WAS | NM_000377.2(WAS): c.134C>T (p.Thr45Met) | CCTGCTTTCCTCTCCCAGAYGCT | Thrombocytopenia, X-linked |
| 200322968 | WDPCP | NM_015910.5(WDPCP): c.160G>A (p.Asp54Asn) | CCAGAGCTCATTTACYCGCAATG | Orstavik Lindemann Solberg syndrome |
| 587777351 | WDR19 | NM_025132.3(WDR19): c.3703G>A (p.Glu1235Lys) | GATCRAGGGAATGGTCAGGTAGG, AGAAGATCRAGGGAATGGTCAGG | Nephronophthisis 13 |
| 587777350 | WDR19 | NM_025132.3(WDR19): c.682C>T (p.Gln228Ter) | CCCAGCTGATCTTGAATTTYAGC, CCAGCTGATCTTGAATTTYAGCA | Nephronophthisis 13 |
| 587777097 | WDR34 | NM_052844.3(WDR34): c.472C>T (p.Gln158Ter) | CTTGGCTGGCGGGTAGCCCAGG | Short-rib thoracic dysplasia 11 with or without polydactyly |
| 116529882 | WDR36 | NM_139281.2(WDR36): c.1586G>A (p.Arg529Gln) | ACATCRAGGAAGTTTTGGCAAGG | Glaucoma 1, open angle, G |
| 587784553 | WDR62 | NM_001083961.1(WDR62): c.332+1G>A | CGCCAGRTAGGCTGAGGCCTGGG, CCGCCAGRTAGGCTGAGGCCTGG | Primary autosomal recessive microcephaly 2 |
| 387907082 | WDR62 | NM_001083961.1(WDR62): c.1313G>A (p.Arg438His) | CACCATTCRCTTCTGGAACTTGG | Primary autosomal recessive microcephaly 2 |

TABLE 2-continued

Target mutations that may be corrected using nucleobase editors, including exemplary gRNA sequences.
gRNA sequences in the table correspond to SEQ ID NOs: 740-5526 from top to bottom.

| RS# (dbSNP) | Gene Symbol | Name | gRNAall | Phenotypes |
|---|---|---|---|---|
| 754099015 | WDR73 | NM_032856.3(WDR73): c.1039C>T (p.His347Tyr) | CAGGTGTRGGTGGTGACCAAAGG | Microcephaly, hiatal hernia and nephrotic syndrome |
| 587776906 | WDR81 | NM_001163809.1(WDR81): c.2567C>T (p.Pro856Leu) | CCTGTCTCCCAGGGCCTGCYCCC | Cerebellar ataxia, mental retardation, and dysequilibrium syndrome 2 |
| 28937895 | WFS1 | NM_006005.3(WFS1): c.2492G>A (p.Gly831Asp) | AGGRCCGCCTGGGCAGCAAGTGG | WFS1-Related Disorders |
| 387906931 | WFS1 | NM_006005.3(WFS1): c.2338G>A (p.Gly780Ser) | GTGRGCATGCCATTCAGCAGCGG | Wolfram-like syndrome, autosomal dominant |
| 104893880 | WFS1 | NM_006005.3(WFS1): c.676C>T (p.Gln226Ter) | CCCAAGTCCCTGCAGAAGYAGAG, CCAAGTCCCTGCAGAAGYAGAGG | Diabetes mellitus AND insipidus with optic atrophy AND deafness |
| 28937890 | WFS1 | NM_006005.3(WFS1): c.2171C>T (p.Pro724Leu) | CCATCAACATGCTCCYGTTCTTC | Diabetes mellitus AND insipidus with optic atrophy AND deafness |
| 28937892 | WFS1 | NM_006005.3(WFS1): c.1511C>T (p.Pro504Leu) | CCTCAACGTCAGCGTCCYGTGCC | Diabetes mellitus AND insipidus with optic atrophy AND deafness |
| 121908899 | WISP3 | NM_003880.3(WISP3): c.434G>A (p.Cys145Tyr) | CTCTRTGTGAGTGGGGCCATTGG | Progressive pseudorheumatoid dysplasia |
| 111033591 | WNK1 | NM_213655.4(WNK1): c.3226C>T (p.Arg1076Ter) | CCTCAGCGTGTTTACYGAAATCG | |
| 111033592 | WNK1 | NM_213655.4(WNK1): c.2575C>T (p.Gln859Ter) | CCCAAACTCACCACTTCYAACCC, CCAAACTCACCACTTCYAACCCC | |
| 146902156 | WNT10A | NM_025216.2(WNT10A): c.649G>A (p.Asp217Asn) | CAGCCCCRACATGGGCTTCGGGG, GCAGCCCCRACATGGGCTTCGGG | Tooth agenesis, selective, 4, not provided |
| 147680216 | WNT10A | NM_025216.2(WNT10A): c.637G>A (p.Gly213Ser) | GGCRGCTGCAGCCCCGACATGGG, GGGCRGCTGCAGCCCCGACATGG | Tooth agenesis, selective, 4 |
| 104894653 | WNT3 | NM_030753.4(WNT3): c.247C>T (p.Gln83Ter) | CCAGGAGTGCCAGCACYAGTTCC | Tetraamelia, autosomal recessive |
| 786204837 | WNT5A | NM_003392.4(WNT5A): c.206G>A (p.Cys69Tyr) | CCTCTCTRCAGCCAACTGGCAGG | Robinow syndrome |
| 104893832 | WNT7A | NM_004625.3(WNT7A): c.325G>A (p.Ala109Thr) | ACCTACRCCATCATTGCCGCCGG | Fuhrmann syndrome |
| 397514643 | WNT7A | NM_004625.3(WNT7A): c.664C>T (p.Arg222Trp) | CCACACTGCCACAGTTTYGGGAG | Ulna and fibula absence of with severe limb deficiency |
| 281865550 | WRAP53 | NM_018081.2(WRAP53): c.1303G>A (p.Gly435Arg) | GAGCRGGGCTGTCTCTGTGTGGG, CGAGCRGGGCTGTCTCTGTGTGG | Dyskeratosis congenita, autosomal recessive, 3 |
| 281865548 | WRAP53 | NM_018081.2(WRAP53): c.1192C>T (p.Arg398Trp) | CCTGTGCTGGGATCTCYGGCAGT | Dyskeratosis congenita, autosomal recessive, 3 |
| 281865549 | WRAP53 | NM_018081.2(WRAP53): c.1126C>T (p.His376Tyr) | CCCACCTCTGCTTTYATCCCGAT | Dyskeratosis congenita, autosomal recessive, 3 |
| 121908446 | WRN | NM_000553.4(WRN): 3913C>T (p.Arg1305Ter) | CCCCCTTGATTTGGAGYGAGCAG, CCCCTTGATTTGGAGYGAGCAGG, CCCTTGATTTGGAGYGAGCAGGC | Werner syndrome |
| 121907909 | WT1 | NM_024426.4(WT1): c.1372C>T (p.Arg458Ter) | CCAGTGTAAACTTGTCAGYGAA | Frasier syndrome, Wilms tumor 1 |
| 72549369 | XDH | NM_000379.3(XDH): c.445C>T (p.Arg149Cys) | CCCACAGGAAATCTGTGCYGCTG, CCACAGGAAATCTGTGCYGCTGC | Deficiency of xanthine oxidase |
| 104894953 | XK | NM_021083.2(XK): c.941G>A (p.Trp314Ter) | CCATAATTGTACCAGTCTACTGG | McLeod neuroacanthocytosis syndrome |
| 201818754 | XYLT1 | NM_022166.3(XYLT1): c.1588-3C>T | GAAGGACTRCAGGGGAGAGAGGG | Desbuquois dysplasia 2 |
| 587777367 | XYLT1 | NM_022166.3(XYLT1): c.1792C>T (p.Arg598Cys) | TGCRGGCAAAGAAGGTAGGCCGG, AACTTGCRGGCAAAGAAGGTAGG | Desbuquois dysplasia 2 |
| 587777368 | XYLT1 | NM_022166.3(XYLT1): c.439C>T (p.Arg147Ter) | TCTGTTCRCACTTTCTCTTTCGG | Desbuquois dysplasia 2 |
| 587777249 | YAP1 | NM_001130145.2(YAP1): c.370C>T (p.Arg124Ter) | CCTGACTCCACAGCATGTTYGAG | Congenital ocular coloboma |
| 121908833 | YARS | NM_003680.3(YARS): c.121G>A (p.Gly41Arg) | TACTGGRGAACGGCAACCACGGG, TTACTGGRGAACGGCAACCACGG | Charcot-Marie-Tooth disease, dominant intermediate C |
| 113994173 | ZAP70 | NM_001079.3(ZAP70): c.837+121G>A | CTGTCTCTRGGAGTCCTCAGTGG | Severe combined immunodeficiency, atypical |
| 137853201 | ZAP70 | NM_001079.3(ZAP70): c.1394G>A (p.Arg465His) | GGCGGCCCRCAACGTCCTGCTGG | Severe combined immunodeficiency, atypical |
| 113994174 | ZAP70 | NM_001079.3(ZAP70): c.1393C>T (p.Arg465Cys) | CCGTGACCTGGCGGCCYGCAACG | Severe combined immunodeficiency, atypical |
| 483353070 | ZBTB20 | NM_001164342.2(ZBTB20): c.1861C>T (p.Leu621Phe) | CCTTAAAGGATTACYTTATCAAG | Primrose syndrome |
| 387907106 | ZBTB24 | NM_014797.2(ZBTB24): c.1369C>T (p.Arg457Ter) | CCCACATCAGAATCCATYGGTAA, CCACATCAGAATCCATYGGTAAA | Immunodeficiency-centromeric instability-facial anomalies syndrome 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730882163 | ZBTB42 | NM_001137601.2(ZBTB42): c.1190G>A (p.Arg397His) | AGCRCCGTTTCACGCAGTCCGGG, GAGCRCCGTTTCACGCAGTCCGG | Lethal congenital contracture syndrome 6 |
| 587784563 | ZEB2 | NM_014795.3(ZEB2): c.1956C>T (p.Tyr652=) | CCCCATCAACCCATAYAAGGACC, CCCATCAACCCATAYAAGGACCA | Mowat-Wilson syndrome |
| 587784566 | ZEB2 | NM_014795.3(ZEB2): c.2761C>T (p.Arg921Ter) | CCAGTATTCCTGGGCTAYGACCA | Mowat-Wilson syndrome |
| 587784571 | ZEB2 | NM_014795.3(ZEB2): c.904C>T (p.Arg302Ter) | CCATCTGAAAGAACACCTGYGAA | Mowat-Wilson syndrome, not provided |
| 387907057 | ZFYVE26 | NM_015346.3(ZFYVE26): c.5422C>T (p.Gln1808Ter) | CCCCCTGCCAGGCACYAGTGGGT, CCCCTGCCAGGCACYAGTGGGTA | Spastic paraplegia 15 |
| 122462165 | ZIC3 | NM_003413.3(ZIC3): c.968C>T (p.Thr323Met) | CCACATCCGAGTGCACAYGGGCG | Heterotaxy, visceral, X-linked |
| 281875376 | ZMPSTE24 | NM_005857.4(ZMPSTE24): c.1349G>A (p.Trp450Ter) | CTGACTRGTTGTTCTCAATGTGG | Mandibuloacral dysplasia with type B lipodystrophy, not provided |
| 121908094 | ZMPSTE24 | NM_005857.4(ZMPSTE24): c.121C>T (p.Gln41Ter) | CCTTCCTAGCACAGCGGYAGGTG | Mandibuloacral dysplasia with type B lipodystrophy, not provided |
| 397515460 | ZMYND10 | NM_015896.3(ZMYND10): c.967C>T (p.Gln323Ter) | CCCTAACTGAAACCYAGCCTCCT | Ciliary dyskinesia, primary, 22 |
| 672601340 | ZMYND11 | NM_006624.5(ZMYND11): c.976C>T | CCTTCTGAAAACATTYAAGATAT | Mental retardation, autosomal dominant 30 |
| 397514642 | ZNF335 | NM_022095.3(ZNF335): c.3332G>A (p.Arg1111His) | GCAGCRGTGAGGCCAGATACTGG | Primary autosomal recessive microcephaly 10 |
| 781192528 | ZNF408 | NM_024741.2(ZNF408): c.1621C>T (p.Arg541Cys) | CCAGCTGCCTGAACTGCGGYGCC | RETINITIS PIGMENTOSA 72 |
| 373273223 | ZNF408 | NM_024741.2(ZNF408): c.1363C>T (p.His455Tyr) | CCGGCCCTCCCTGCGGCTGYATC, CCCTCCCTGCGGCTGYATCGCAA, CCTCCCTGCGGCTGYATCGCAAG | Exudative vitreoretinopathy 6 |
| 273585629 | ZNF469 | NM_001127464.2(ZNF469): c.11101G>A (p.Gly3701Ser) | AAACCCRGCCCCAGCTCCCAGGG, CAAACCCRGCCCCAGCTCCCAGG | Keratoconus 1 |
| 387907062 | ZNF469 | NM_001127464.2 (ZNF469):c.10016G>A (p.Cys3339Tyr) | CCTGTRCCCCCGGTGCCCCCGGG, ACCTGTRCCCCCGGTGCCCCCGG | Corneal fragility keratoglobus, blue sclerae AND joint hypermobility |
| 273585617 | ZNF469 | NM_001127464.2(ZNF469): c.290C>T (p.Pro97Leu) | CCCCCAGACCCCACYGGGGAGAA | Keratoconus 1 |
| 273585630 | ZNF469 | NM_001127464.2(ZNF469): c.11615C>T (p.Pro3872Leu) | CCTTCCCCAGGGGAGACYCCTG, CCCCCAGGGGAGACYCCTGCTCA | Keratoconus 1 |

In some embodiments, a fusion protein recognizes canonical PAMs and therefore can correct the pathogenic G to A or C to T mutations with canonical PAMs, e.g., NGG, respectively, in the flanking sequences. For example, Cas9 proteins that recognize canonical PAMs comprise an amino acid sequence that is at least 80%, 85%, 90%, 95%, 97%, 98%, or 99% identical to the amino acid sequence of *Streptococcus pyogenes* Cas9 as provided by SEQ ID NO: 52, or to a fragment thereof comprising the RuvC and HNH domains of SEQ ID NO: 52.

It will be apparent to those of skill in the art that in order to target any of the fusion proteins comprising a Cas9 domain and an adenosine deaminase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcua-gaaauagcaaguuaaaauaaaggcuaguccguuaucaacuugaaaaagug-gcaccgagucggugcuu uuu-3' (SEQ ID NO: 389), wherein the guide sequence comprises a sequence that is complementary to the target sequence. In some embodiments, the guide sequence comprises any of the nucleotide sequences provided in Table 2 The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are shown below in Table 3, including their locus.

TABLE 3

Additional target sites.

| locus | 5 to 3' |
|---|---|
| other sites within HEK2 locus | GAACACAAAGCATAGACTGC (SEQ ID NO: 390) |

TABLE 3-continued

Additional target sites.

| locus | 5 to 3' |
|---|---|
| other sites within HEK2 locus | GGAACACAAAGCATAGACTG (SEQ ID NO: 391) |
| other sites within HEK2 locus | AACACAAAGCATAGACTGCG (SEQ ID NO: 392) |
| other sites within HEK2 locus | ACAAAGCATAGACTGCGGGG (SEQ ID NO: 393) |
| other sites within HEK2 locus | CAAAGCATAGACTGCGGGGC (SEQ ID NO: 394) |
| other sites within HEK2 locus | GTGGTAATTTTCCAGCCCGC (SEQ ID NO: 395) |
| other sites within HEK2 locus | CCTTTACAGGGCCAGCGGGC (SEQ ID NO: 396) |
| other sites within HEK2 locus | CTGTCACAGTTAGCTCAGCC (SEQ ID NO: 397) |
| other sites within HEK2 locus | GTGTTCCAGTTTCCTTTACA (SEQ ID NO: 398) |
| Hek-2 guideSEQ off-target | GAACACAATGCATAGATTGC (SEQ ID NO: 399) |
| Hek-2 similar site | GAAAAAAAGCAGAGACTGC (SEQ ID NO: 400) |
| Hek-2 similar site | GAATACTAAGCATAGACTCC (SEQ ID NO: 401) |
| Hek-2 similar site | GTAAACAAAGCATAGACTGA (SEQ ID NO: 402) |
| Hek-2 similar site | GGACACAAAGCTTAGACTCC (SEQ ID NO: 403) |
| Hek-2 similar site | CAATACAAAGGATAGACTGC (SEQ ID NO: 404) |
| Hek-2 similar site | GAAGACCAAGGATAGACTGC (SEQ ID NO: 405) |
| Hek-2 similar site | GAAAACAAATCATTGACTGC (SEQ ID NO: 406) |
| Hek-2 similar site | GATCACAAAGCATGGACTGA (SEQ ID NO: 407) |
| Hek-2 similar site | GAAAACAAAACATAGAGTGC (SEQ ID NO: 408) |
| Hek-2 similar site | GAACATAAAGAATAGAATGA (SEQ ID NO: 409) |
| EMX1 | GAGTCCGAGCAGAAGAAGAA (SEQ ID NO: 410) |
| FANCF: | GGAATCCCTTCTGCAGCACC (SEQ ID NO: 411) |
| HEK293 site 2: | GAACACAAAGCATAGACTGC (SEQ ID NO: 412) |
| HEK293 site 3: | GGCCCAGACTGAGCACGTGA (SEQ ID NO: 413) |
| HEK293 site 4: | GGCACTGCGGCTGGAGGTCC (SEQ ID NO: 414) |
| RNF2: | GTCATCTTAGTCATTACCTG (SEQ ID NO: 415) |

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. in some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the first nucleobase is an adenine. In some embodiments, the second nucleobase is a deaminated adenine, or inosine. In some embodiments, the third nucleobase is a thymine. In some embodiments, the fourth nucleobase is a cytosine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., A:T to G:C). In some embodiments, the fifth nucleobase is a guanine. In some embodiments, at least 5% of the intended base pairs are edited. In some embodiments, at least 10%, 15%, 20%, 25%, 30%, 35%, 40%, 45%, or 50% of the intended base paires are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine. In some embodiments, the first base is adenine. In some embodiments, the second base is not a G, C, A, or T. In some embodiments, the second base is inosine. In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is inosine. In some embodiments, the base editor inhibits base excision repair of the edited strand. In some embodiments, the base editor protects (e.g., form base excision repair) or binds the non-edited strand. In some embodiments, the nucleobase editor comprises UGI activity. In some embodiments, the base editor comprises a catalytically inactive inosine-specific nuclease. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2,3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Kits, Vectors, Cells

Some aspects of this disclosure provide kits comprising a nucleic acid construct comprising a nucleotide sequence encoding an adenosine deaminase capable of deaminating an adenosine in a deoxyribonucleic acid (DNA) molecule. In some embodiments, the nucleotide sequence encodes any of the adenosine deaminases provided herein. In some embodiments, the nucleotide sequence comprises a heterologous promoter that drives expression of the adenosine deaminase.

Some aspects of this disclosure provide kits comprising a nucleic acid construct, comprising (a) a nucleotide sequence encoding a napDNAbp (e.g., a Cas9 domain) fused to an adenosine deaminase, or a fusion protein comprising a napDNAbp (e.g., Cas9 domain) and an adenosine deaminase as provided herein; and (b) a heterologous promoter that drives expression of the sequence of (a). In some embodiments, the kit further comprises an expression construct encoding a guide nucleic acid backbone, (e.g., a guide RNA backbone), wherein the construct comprises a cloning site positioned to allow the cloning of a nucleic acid sequence identical or complementary to a target sequence into the guide nucleic acid (e.g., guide RNA backbone).

Some aspects of this disclosure provide cells comprising any of the adenosine deaminases, fusion proteins, or complexes provided herein. In some embodiments, the cells comprise a nucleotide that encodes any of the adenosine deaminases or fusion proteins provided herein. In some embodiments, the cells comprise any of the nucleotides or vectors provided herein.

The description of exemplary embodiments of the reporter systems above is provided for illustration purposes only and not meant to be limiting. Additional reporter systems, e.g., variations of the exemplary systems described in detail above, are also embraced by this disclosure.

It should be appreciated however, that additional fusion proteins would be apparent to the skilled artisan based on the present disclosure and knowledge in the art.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Data provided in the below examples describe engineering of base editors that are capable of catalyzing hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). The first deoxyadenosine deaminases were evolved to accept DNA substrates and deaminate deoxyadenosine (dA) to deoxyinosine. As one example, evolution experiments were performed using the adenosine deaminase acting on tRNA (ADAT) from *Escherichia coli* (TadA, for tRNA adenosine deaminase A), to engineer adenosine deaminases that act on DNA. Briefly, ecTadA was covalently fused to a dCas9 domain, and libraries of this fusion were assembled containing mutations in the deaminase portion of the construct. In the evolution experiments described below, several mutations in ecTadA were found to improve the ability of ecTadA to deaminate adenosine in DNA.

Example 1

Evolution of Adenosine Base Editors (Evolution #1)

Evolution of adenosine base editors (ABEs) was achieved by creating librars of an ecTadA-XTEN-dead Cas9 construct (pNMG-104) via error-prone PCR, which was mutagenized in the ecTadA portion of the editor only. Selection of editors capable of catalyzing A to I deamination on DNA (A to G reversion) was selected for using an antibiotic selection platform. For the first round of evolution (Evolution #1), an adenosine base editor (ABE) library was co-expressed with a gRNA that targeted an active site mutation in a chloramphenicol acetyl-transferase gene, which requires an A to G reversion to restore acetyl-transferase activity and subsequent survival on chloramphenicol selection media. The selection plasmid is co-transformed into the S1030 host strain along with the ABE library. Evolution #1 was conducted and mutations D108N and A106V were idenitified as two mutations which enable A to G reversions on DNA. The D108N mutation more efficiently induced A to G reversions in DNA than A106V. Sequence alignment studies with *S. aureus* TadA revealed that residue D108 participates in H-bond contacts with the 2' OH of the ribose sugar in the wild-type, tRNA substrate. In DNA, this 3' OH is replaced with a 3' H.

Wild-type Adenosine Deaminases and A to G Deaminases

Figure 1:
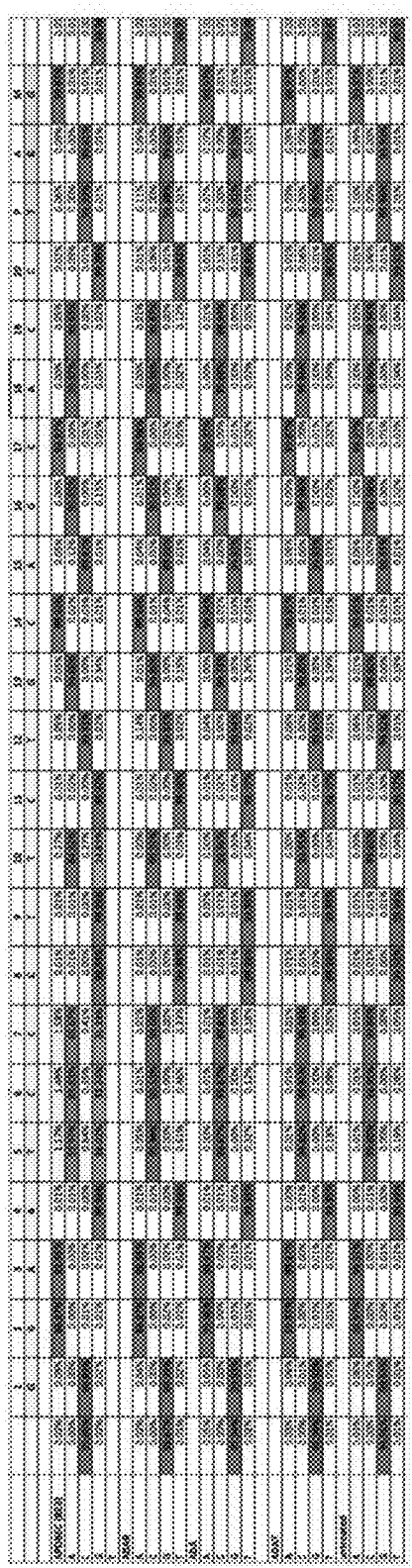
FIG. 1 shows high throughput screen results with various deaminases. APOBEC (BE3) is the positive control; ADAR acts on mRNA, ADA acts on deoxyadenosine, and ADAT acts on tRNA. The untreated group is the negative control. The sequence corresponds to SEQ ID: 45.

Transfection of various A to G deaminase fusions (+XTEN-nCas9) into Hek293T cells did not cause A to G SNP at the targeted sites. Six different sites were targeted, but none of the wild-type adenosine deaminase Cas9 fusions produced observable A to G modifications in DNA. BE3 (rAPOBEC1-XTEN-nCas9-UGI-NLS) was used as positive control. The following wild-type deaminase-nCas9 fusions were tested: ADAR (acts on mRNA), ADA (acts on deoxyadenosine), and ADAT (acts on tRNA) (FIG. 1).

Figure 2:
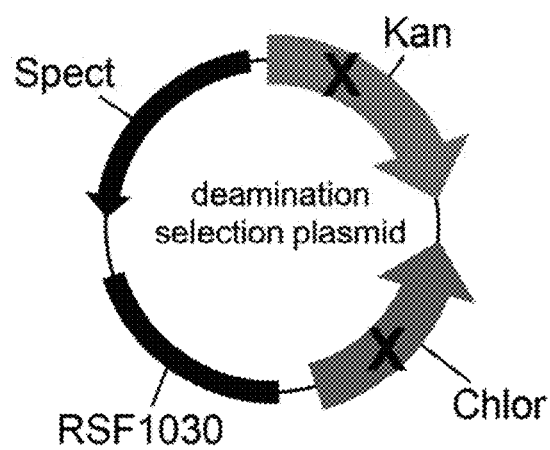
FIG. 2 is a schematic of a deamination selection plasmid.

A to G deaminases which act on DNA were developed. First, an antibiotic selection plasmid was developed, in which restoration of the active site residue in the antibiotic-resistant gene (A to G reversion) resulted in the host's resistance to antibiotic challenges. A high copy plasmid (RSF1030), was constructed. It required either a STOP reversion to a wild-type amino acid (Kan) or an active site residue restoration (Chlor). Specifically, on the template strand, the STOP needed to revert to glutamic acid (Kan) or tyrosine needed to revert to histidine (a cationic residue) (Chlor) (FIG. 2).

Figure 3:
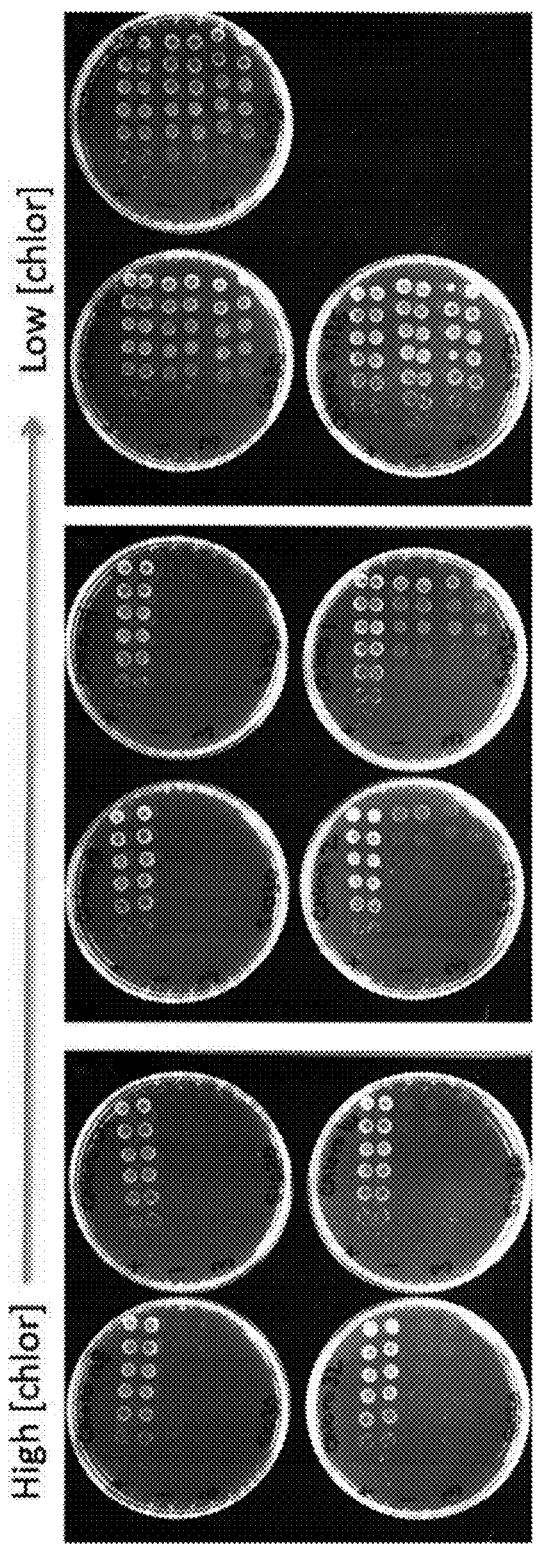
FIG. 3 shows a serial dilution of the selection plasmid in S1030 cells plated on increasing concentrations of chloramphenicol.

The minimum inhibitory concentration (MIC) was determined by the selection plasmid. The A to I selection plasmid was grown in S1030, and plated on varying concentrations of chloramphenicol. The MIC was found to be approximately 1 µg/mL. A serial dilution of the selection plasmid in S1030 cells (the host strain) plated on increasing concentrations of chlor (FIG. 3). Cells harboring library members which survive on concentrations of chlor above 1 µg/mL were considered to be possible hits.

Figure 4:
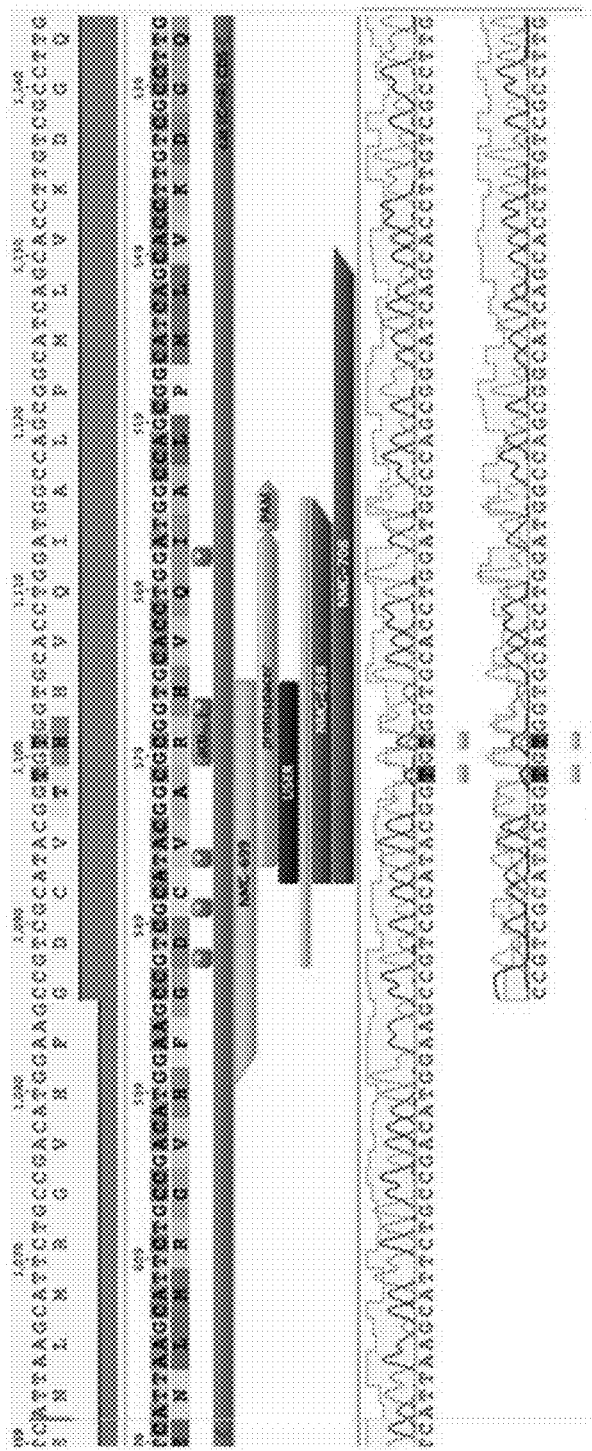
FIG. 4 shows the validation of chloramphenicol selection with a rAPOBEC1-XTEN-dCas9 construct as a positive control. The sequences from top to bottom correspond to SEQ ID NOs: 95 (the nucleotide sequence), 96 (the amino acid sequence), 97 (the nucleotide sequence), 98 (the amino acid sequence), 95 (the nucleotide sequence) and 99 (the truncated nucleotide sequence).

The chloramphenicol (Chlor) selection was further validated using rAPOBEC1-XTEN-dCas9 construct as a positive control. Colonies that survived at 8 µg/mL chlor were then sequenced, and the C to T reversion was observed in DNA (FIG. 4). The assay was performed by growing cells with the selection plasmid and deaminase fusion to $OD_{600\ nm}$~0.3 and then inducing fusion expression overnight. The resulting culture was then plated on increasing concentrations of chloramphenicol and the desired DNA reversion was screened.

An A to I deaminase library was then generated. Optimized assembly/library generation conditions, including PreCR vs. USER, electroporation vs. chemical composition, nucleofection vs. electroporation, outgrowth time, SOC vx. DRM, and sub-cloning vs. direct transformation, were examined. After the library assembly/electroporation conditions were optimized the following two libraries were made: APOBEC-XTEN-dCas9 and ADAT-XTEN-dCas9. The average library size was 2-4×10$^6$ based on the calculated colony-forming unit (CFU). The APOBEC-XTEN-dCas9 library produced no useful hits. The ADAT-XTEN-dCas9 library produced successful. The ADAT used was TadA (truncated) in *E. coli*.

Architecture of the Deaminase Library

Figure 5:
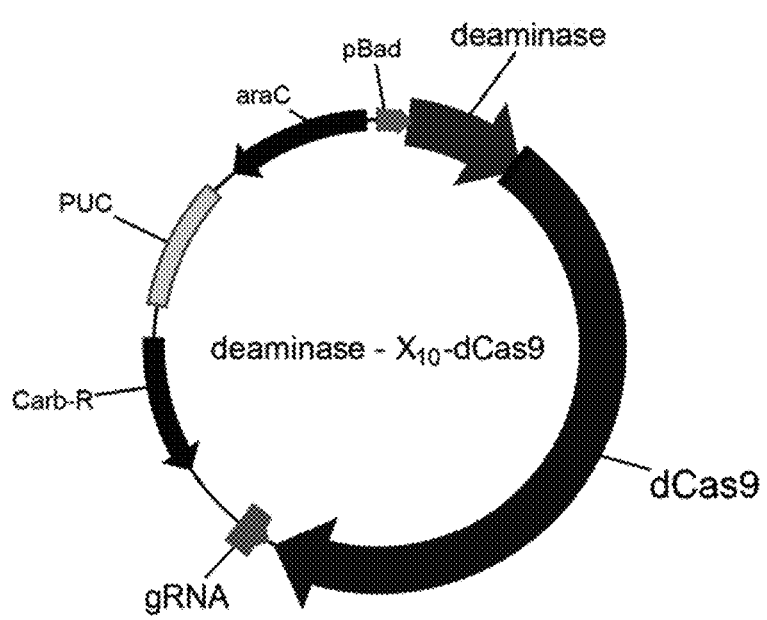
FIG. 5 is a schematic of a deaminase-XTEN-dCas9 construct.

The deaminase-XTEN-dCas9 fusion includes a SC101 backbone and a gRNA (lac promoter) to target the chloroamphernicol site (FIG. 5). Only deaminase is subjected to error-prone PCR, and the assembly is two-piece PreCR (a modified USER protocol). The gRNA is driven by the lac promoter; it targets the Chlor active site. A to G reversion is needed at position 9 of the protospacer to restore the His active site (a tyrosine to histidine reversion). Repair is needed and targeted on the template strand. APOBEC/CDA was used as a positive control. A to I constructs included the following: mADA, ADAR1, and ADAT2.

A TadA-XTEN-dCas9 library was also constructed. Error Prone PCR on TadA enzyme only was used. The optimized protocol was used and resulting constructs were subcloned.

Figure 6:
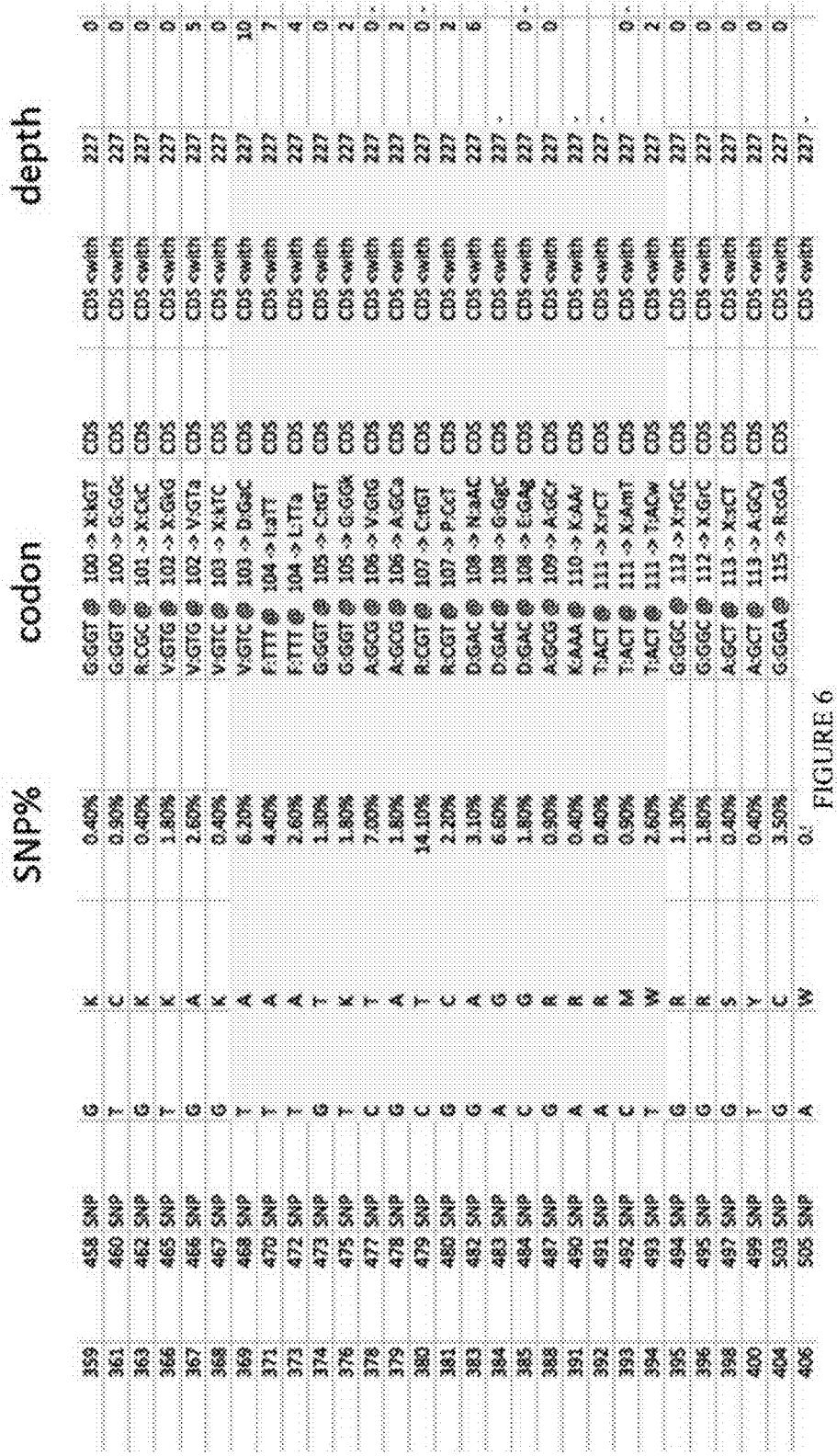
FIG. 6 shows the sequencing results from the first round of the TadA-XTEN-dCas9 library.
Figure 7:
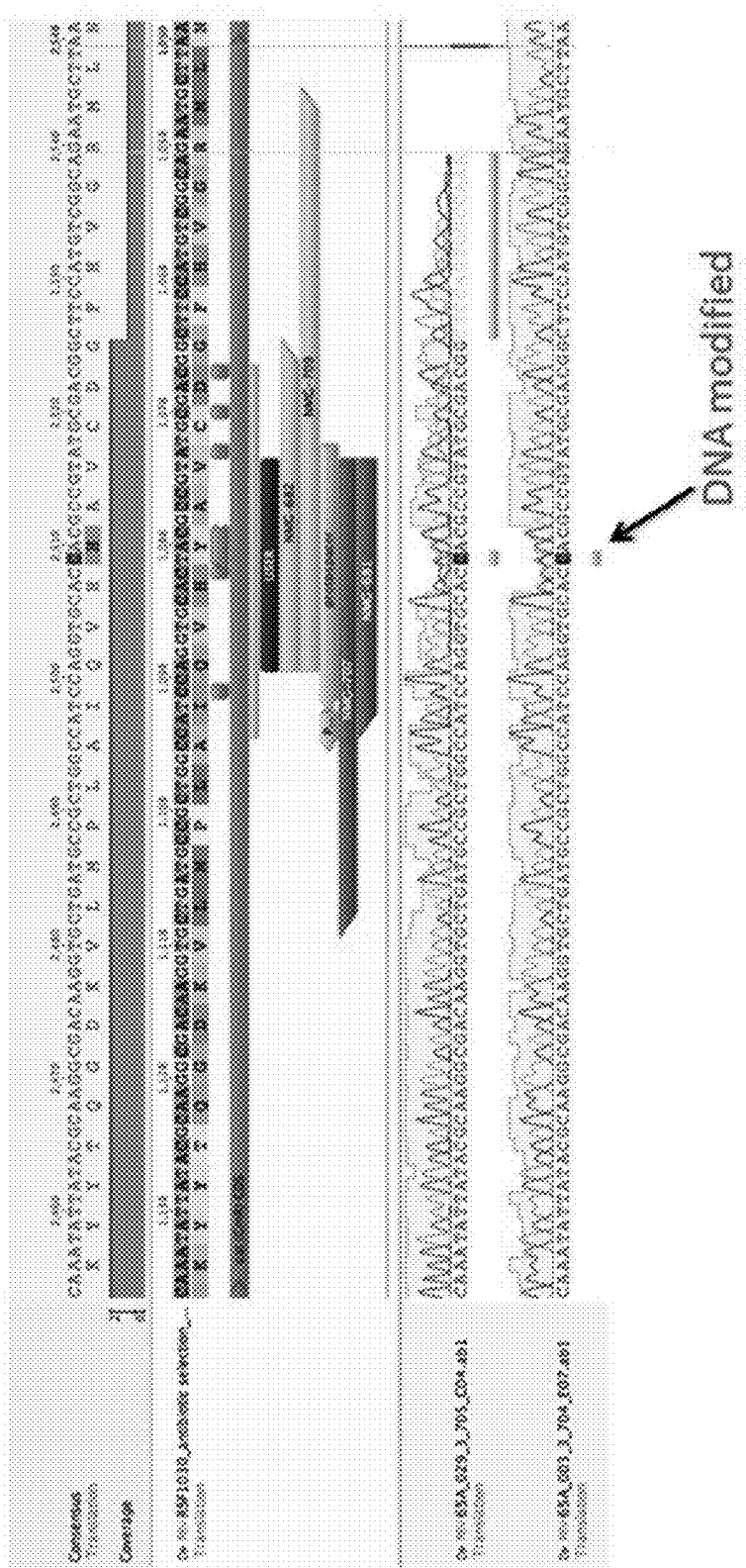
FIG. 7 shows the sequence of a selection plasmid; an A to G reversion was observed. The sequences from top to bottom correspond to SEQ ID NOs: 100 (the nucleotide sequence), 101 (the amino acid sequence), 102 (the nucleotide sequence), 103 (the amino acid sequence), 104 (the nucleotide sequence), and 100 (the nucleotide sequence).

S1030 cells (with the selection plasmid) were transformed with a TadA*-XTEN-dCas9 randomized library. Protein expression was induced after a recovery phase. The library was then plated the next day on increasing concentrations of chloramphenicol (0.5, 1, 2, and 4 μg/mL) onto separate 24×24 cm plates and incubated overnight. TadA(wt)-XTEN-dCas9 was used as a negative control. Colonies grew on all four places, and as concentrations increased, fewer colonies were observed. The negative control had far fewer colonies than the plates with library members. Eight selection plasmids were sequenced and all plasmids contained the A to G reversion at the targeted site. In all, 120 colonies were PCR-amplified and then sequenced. The results of the first round of sequencing are shown in FIG. 6. An exemplary sequence of a selection plasmid with the A to G reversion is given in FIG. 7. The target is the template strand's A to G (observed as T to C in coding). The example shows about 50% reversion in the Sanger trace (Y to H).

Figure 8:
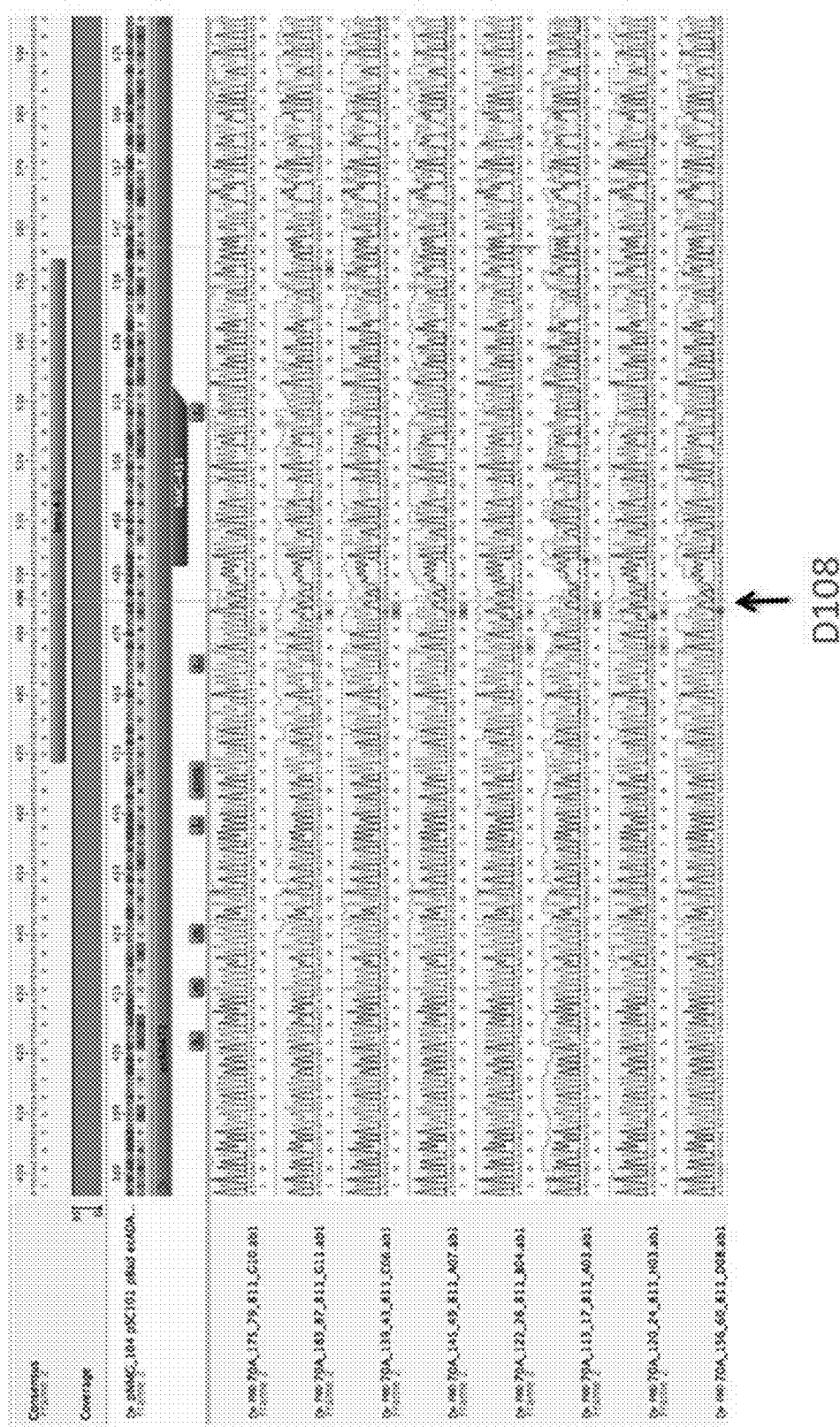
FIG. 8 shows the results of deaminase sequencing, illustrating the convergence at residue D108. The sequences correspond to SEQ ID NOs: 589-607 from top to bottom.
Figure 9:
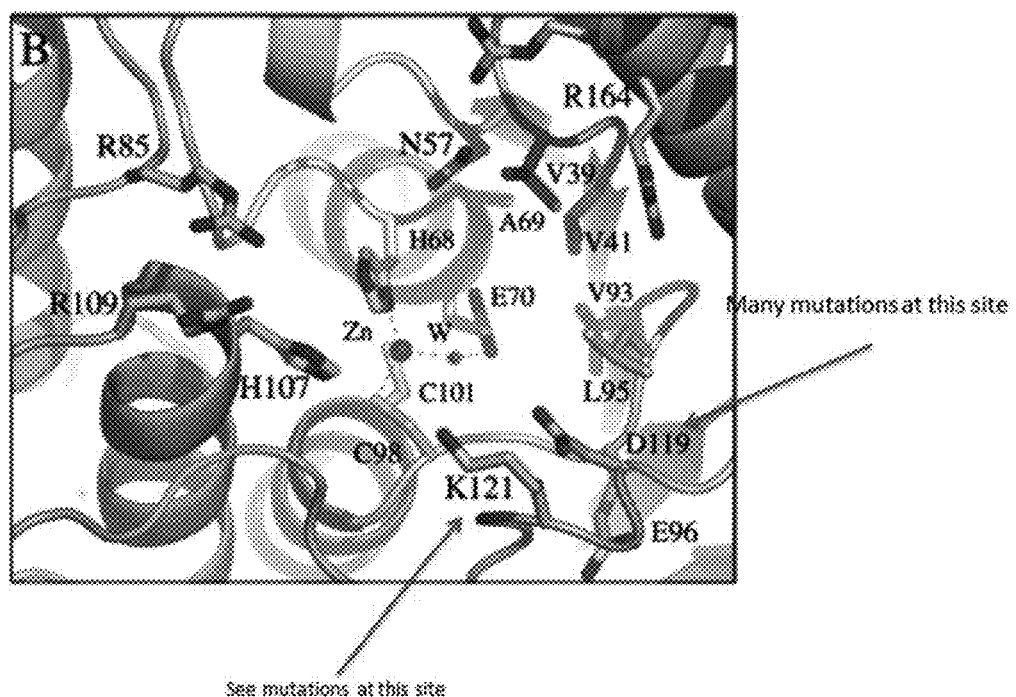
FIG. 9 shows the *E. coli* TadA crystal structure. Note that D119 in the figure corresponds to D108, as the residue numbering isoffset in the figure.
Figure 10:
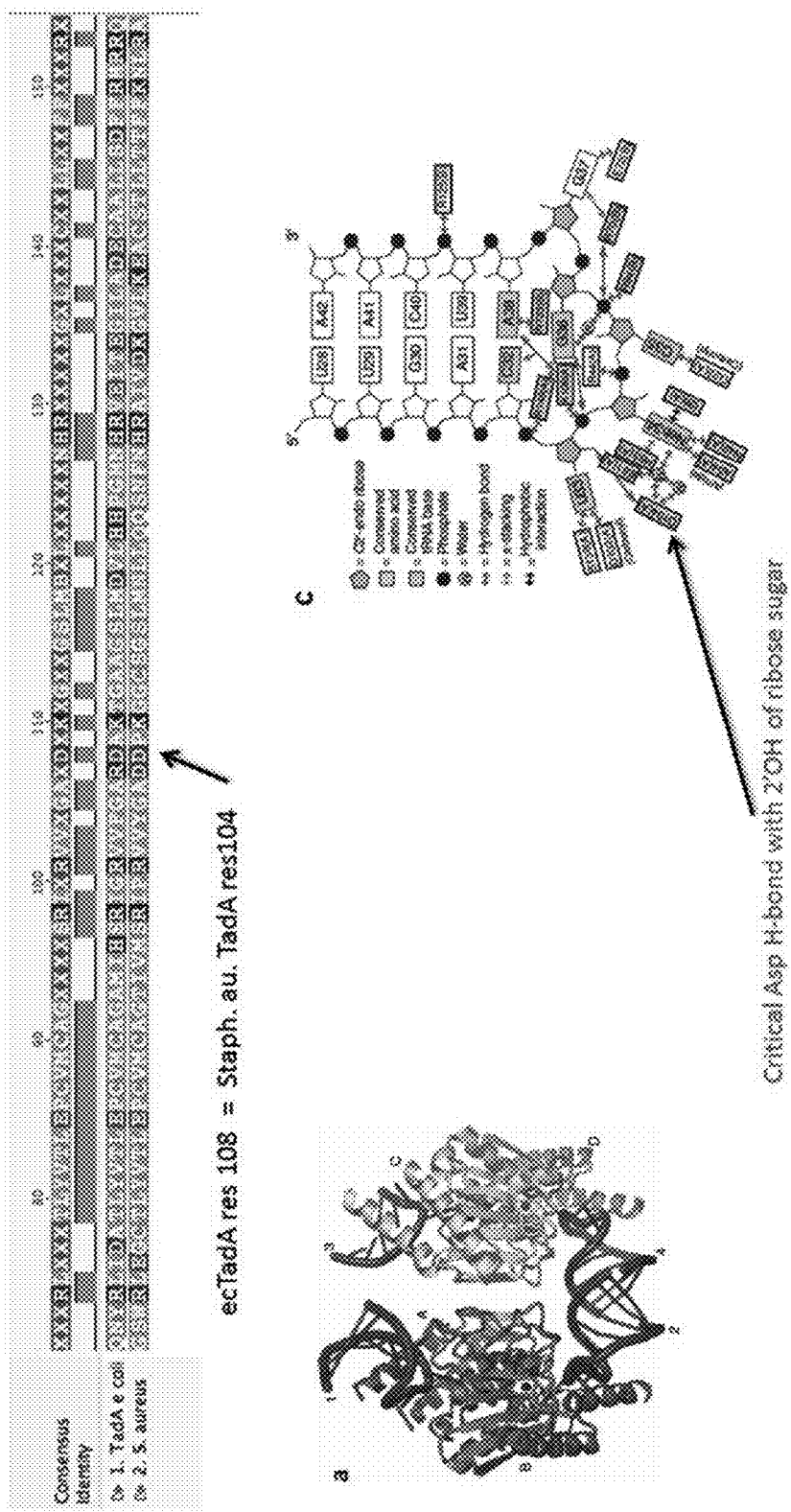
FIG. 10 shows the crystal structure of TadA (in *S. aureus*) tRNA and an alignment of with TadA from *E. coli*. The sequences from top to bottom correspond to SEQ ID NOs: 105-107.

A convergence at residue D108 was observed (FIG. 8). The crystal show of *E. coli* TadA is shown in FIG. 9. D119 in the figure is D108, as the residue numbers are offset. Many mutations were found to occur in that residue. FIG. 10 shows the crystal structure of Tad A (*S. aureus*) and aligns the sequences with that of *E. coli*. ecTadA residue 108 is equivalent to *S. aureus* TadA residue 104, which is part of a critical asparagine hydrogen bond with 2'OH of a ribose sugar.

Selection plasmids used in the evolution experiments contain mutations in various antibiotic resistance genes, which are targeted by adenosine base editors. Below are target sequences of the various antibiotic resistance genes (SEQ ID NOs: 441-444), where the targeted adenine required to restore resistance to its respective antibiotic is shown in bold and underlined. The plasmids used were high-copy plasmids with a RSF1030 origin.

```
Chloramphenicol target (H193Y):
5'-TACGGCGTAGTGCACCTGGA-3'      (SEQ ID NO: 441)

Kanamycin target 1 (Q4Term):
5'-ATCTTATTCGATCATGCGAA-3'      (SEQ ID NO: 442)

Kanamycing target 2 (W15Term):
5'-GCTTAGGTGGAGCGCCTATT-3'      (SEQ ID NO: 443)

Spectinomycin target (T89I):
5'-CAATGATGACTTCTACAGCG-3'      (SEQ ID NO: 444)
```

Mammalian codon optimized constructs were made by ordering a mammalian codon optimized version of ecTadA from Integrated Dna Technologies (IDT) as a gene block. This gene block was used to make pNMG-142, which served as a template for all subsequent mammalian codon-optimized constructs. See Table 4. After mutations were identified from the various rounds of evolution, primers were designed and orderd to introduce desired mutation(s) into the mammalian construct.

ecTadA Evolution and Challenge

Figure 11:
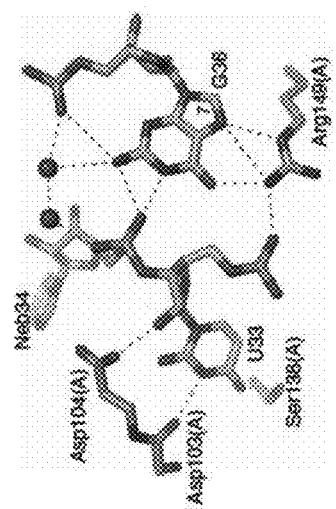
FIG. 11 shows results from the isolation and challenge of individual constructs from ecTadA evolution.

Individual constructs from the ecTadA evolution were isolated and challenged. Sixteen clones were sub-cloned, resulting in the first round of evolution. Each of the 16 clones were transformed in S1030 cells with selection plasmid and challenged with increasing doses of chloramphenicol. rAPOBEC1-XTEN-dCas9, which has a C to T reversion at the same site, was used as a control. The results are shown in FIGS. 11 and 12. FIG. 12 shows the C.F.U. of various constructs challenged on increasing concentrations of chloramphenicol. Constructs 3 and 4 performed the best under the assay's conditions. D108N is a key mutation.

Figure 19:
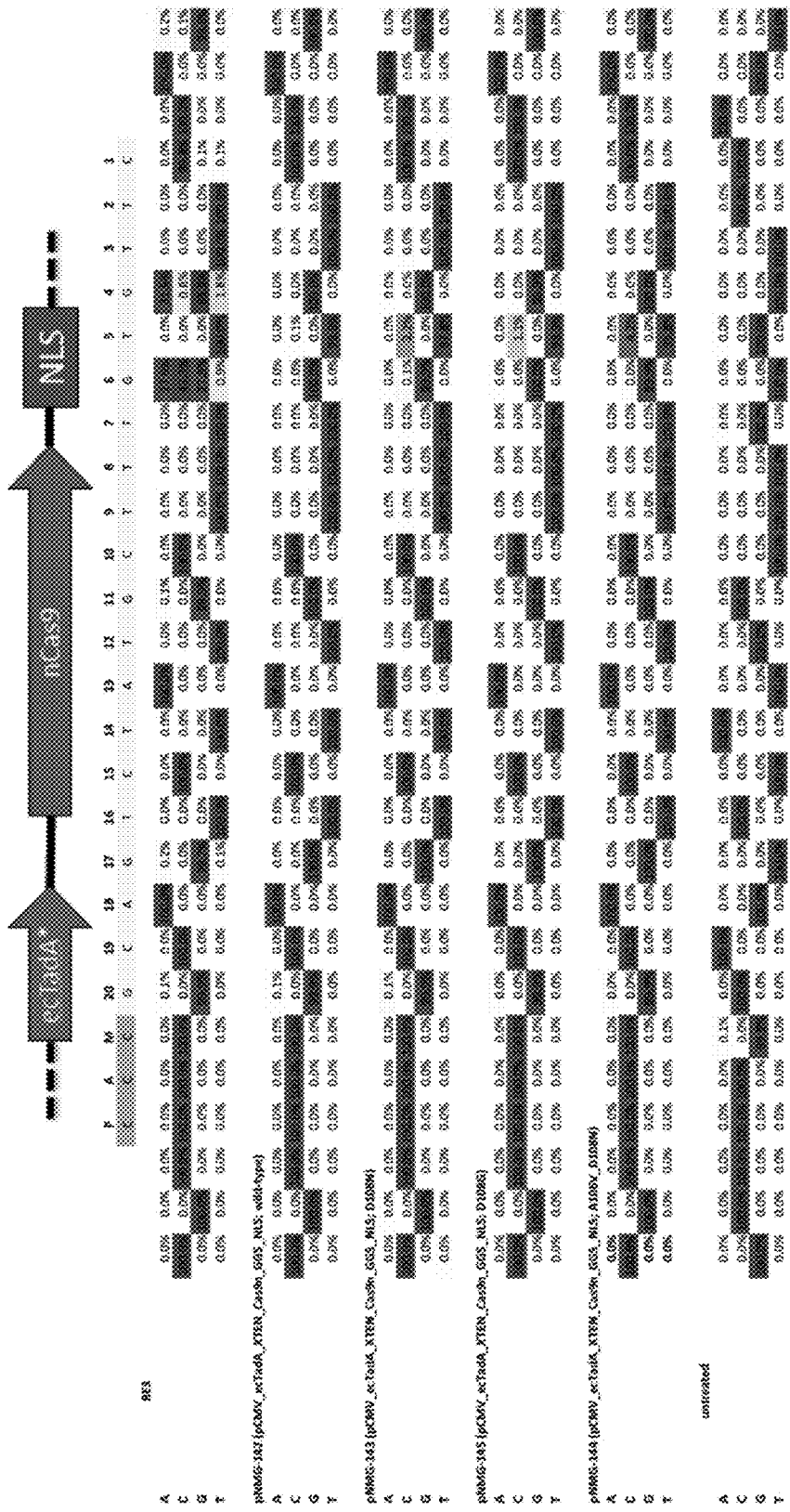
FIG. 19 shows the transfection of constructs into mammalian cells containing single or double mutations in ecTadA. The sequence corresponds to SEQ ID NO: 41.
Figure 20:
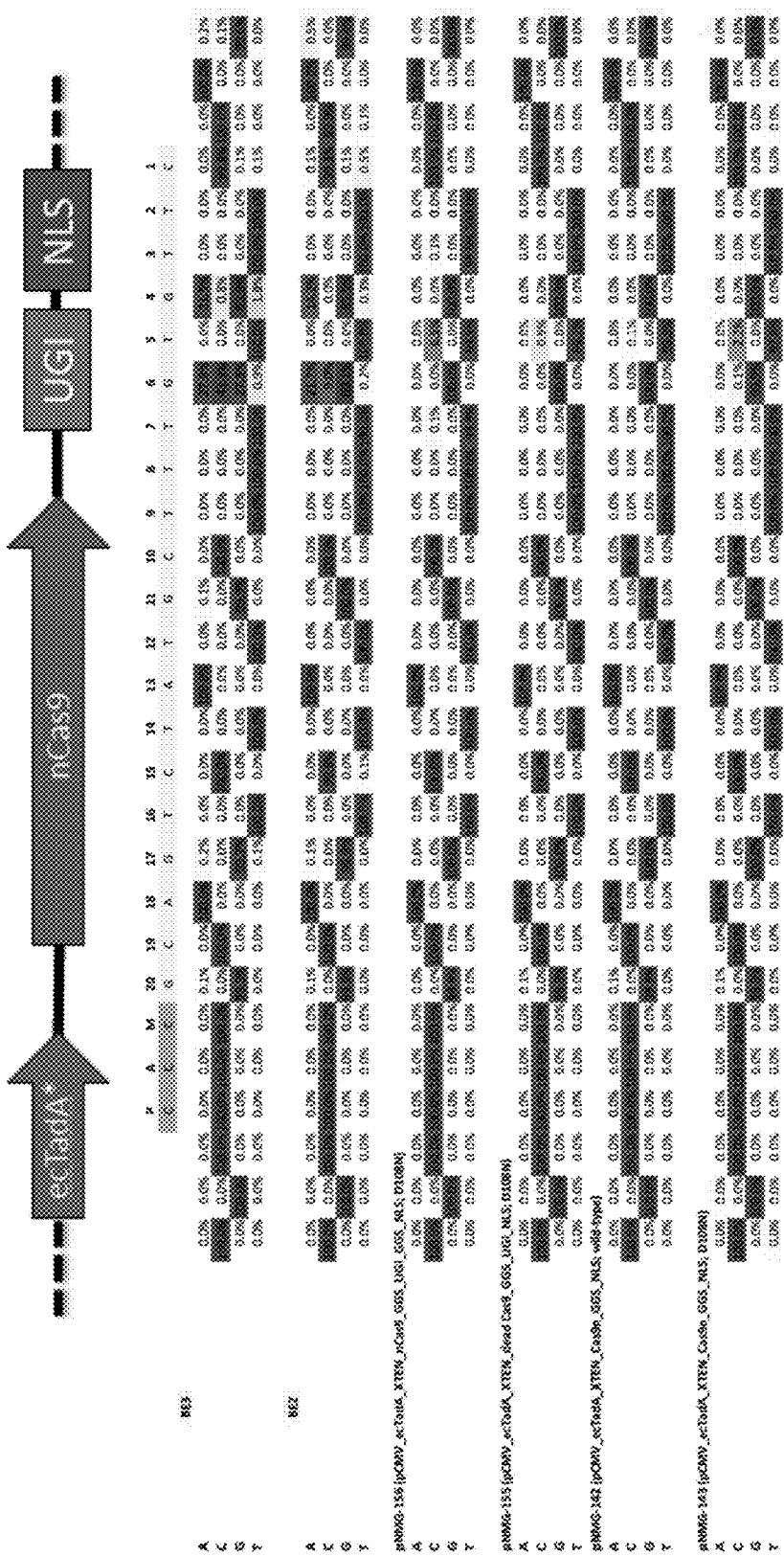
FIG. 20 shows the transfection of constructs with the addition of UGI to adenosine nucleobase editor (ABE) (D108N). The sequence corresponds to SEQ ID NO: 41.
Figure 22:
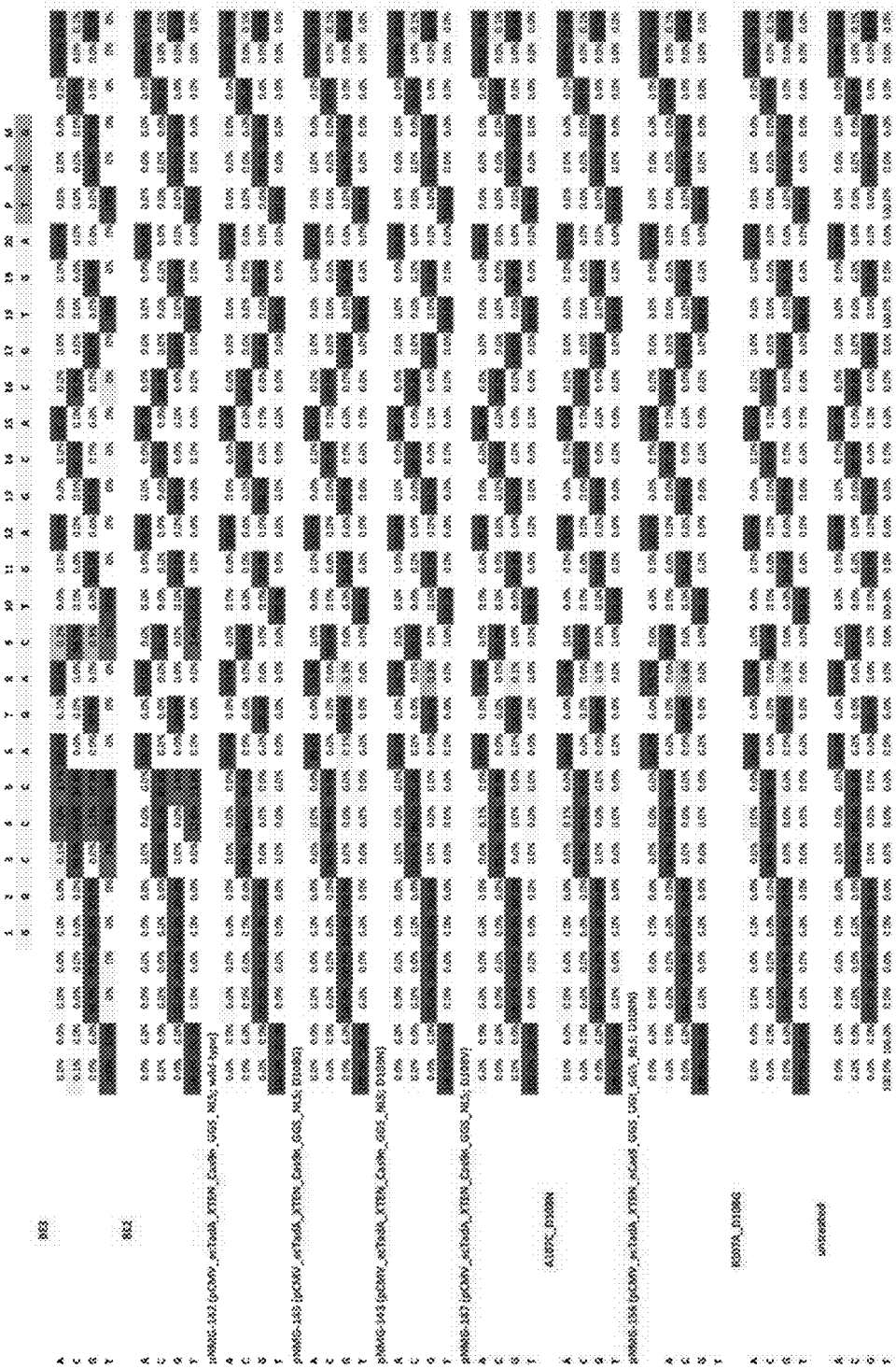
FIG. 22 shows that the Hek-3 site also has lower editing relative to the Hek-2 site editing at position 8 of the protospacer. The sequence corresponds to SEQ ID NO: 42.

Base editors, having mutations at residue D108 of ecTadA are capable of generating an adenine to guanine mutation in DNA via hydrolytic deamination of adenine, which results in inosine formation at the adenine site. Inosine is the read as guanine by DNA polymerase. See FIGS. 18-22, and 129-139, which show the ability of various base editors to generate an adenine to guanine mutation in DNA in various target DNA sequences, such as Hek2 (FIGS. 19, 20, and 129), Hek 2-1 (FIG. 130), Hek 2-2 (FIG. 131), Hek 2-3 (FIG. 132), Hek 2-4 (FIG. 133), Hek 2-6 (FIG. 134), Hek 2-9 (FIG. 135), Hek 2-10 (FIG. 136), RNF2 (FIG. 138), FANCF (FIG. 139), EMX1 (FIG. 21), and Hek3 (FIGS. 22 and 137). In these experiments the D108N mutation as most efficient for generating an A to G mutation, with the addition of an A106V mutation improving efficiency further. Additionally, base editors more efficiently generated A to G mutations at the Hek2 site than any other site tested. In the figures, BE3 and BE2 refer to base editors that induce C to G mutations and act as a positive control for C to G base editing.

Figure 13:
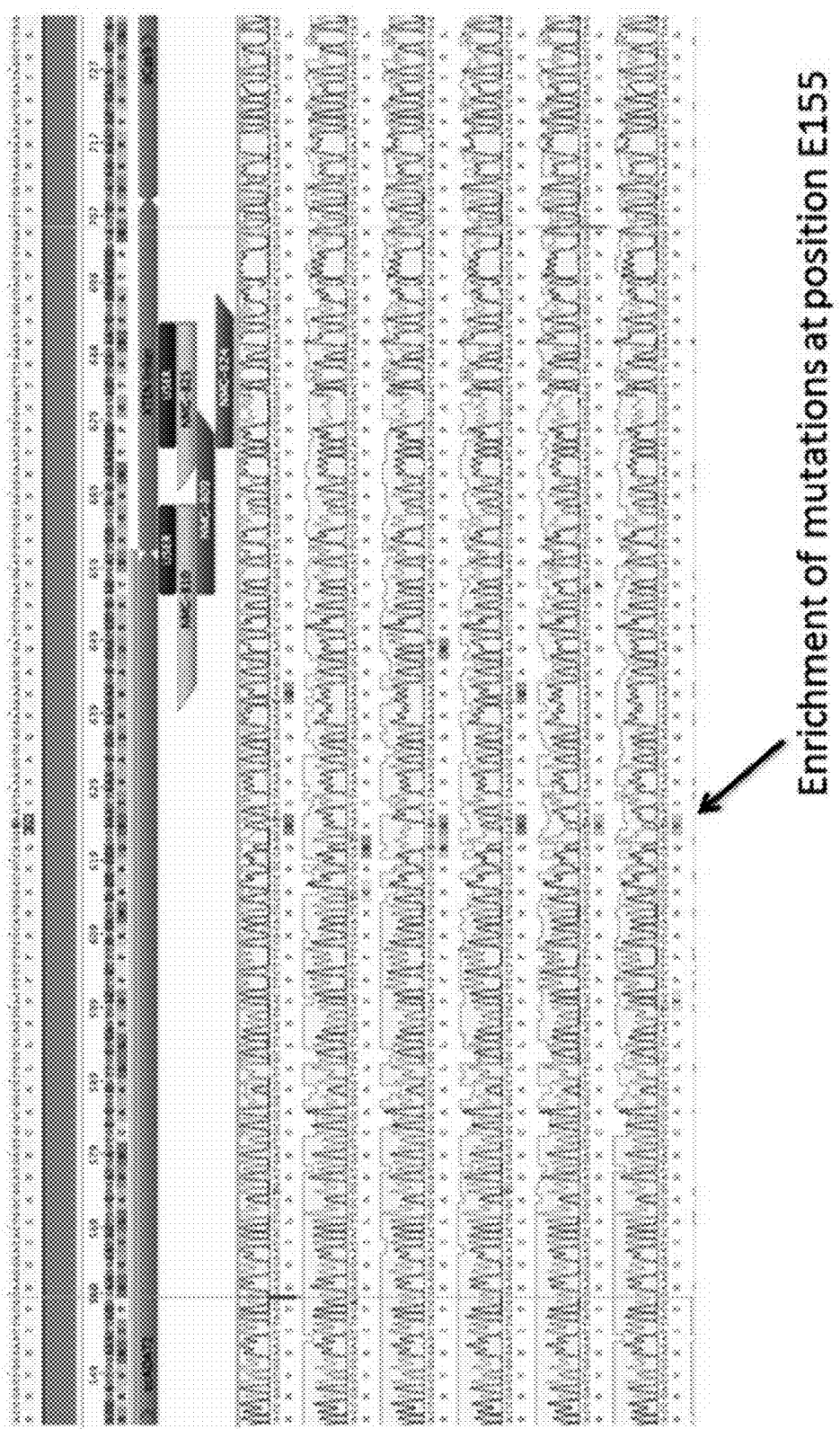
FIG. 13 shows data from the second round of evolution from the constructs containing the D108N mutation. The sequences from top to bottom correspond to SEQ ID NOs: 608-623.

A second round of evolution, described in greater detail below, was performed. Constructs containing the D108N mutation were randomized (plasmid NMG-128). The selection assay was repeated, and the clones were challenged with high concentrations of chloramphenicol. The resulting material was sub-cloned, and the selection assay was repeated. The resulting colonies that survived on high concentrations of chloramphenicol were then sequenced. An enrichment of mutations at position E155 was observed (FIG. 13).

A to G Editing in Mammalian Cells

Figure 14:
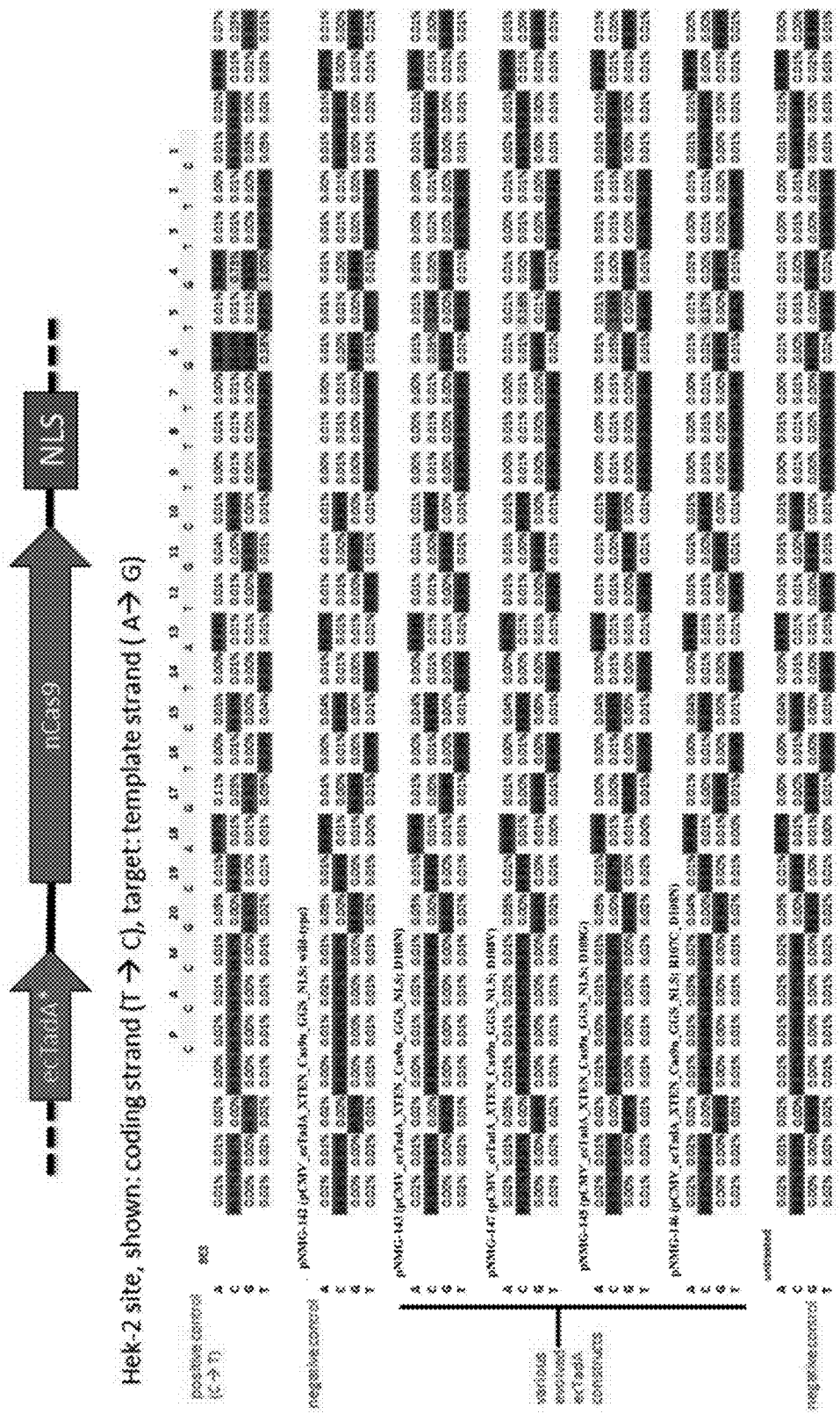
FIG. 14 shows A to G editing in mammalian cells. The sequence corresponds to SEQ ID NO: 41.

A to G editing in was examined in mammalian (Hek293T) cells. As shown in FIG. 14, the editing (from A to G) occurred in the various evolved ecTadA constructs, while it did not occur in the negative controls. The constructs used in the experiments described herein (e.g., Evolution #1-#7) are shown in Table 4. Table 4 includes the construct name, the construct architecture, and the ecTadA mutations. In table 4, pCMV refers to the expression vector comprising the construct. ecTadA refers to the ecTadA of SEQ ID NO: 1, however, for constructs comprising two ecTadA sequences, the second (C-terminal to the first ecTadA) ecTadA sequence does not comprise an N-terminal methionine. Table 4 also lists the mutations in ecTadA relative to SEQ ID NO: 1. Wild-type ecTadA refers to SEQ ID NO: 1. When two ecTadA domains are present the mutations in both ecTadA domains are indicated with the N-terminal ecTadA being indicated first. The 24 a.a linker refers to the amino acid sequence SGGSSGGSSGSETPGTSESATPES (SEQ ID NO: 685), the 32 a.a linker refers to the amino acid sequence SGGSSGGSSGSETPGTSESATPESSGGSSGGS (SEQ ID NO: 385), the 40 a.a linker refers to the amino acid sequence SGGSSGGSSGSETPGTSESAT-PESSGGSSGGSSGGSSGGS (SEQ ID NO: 686), the 64 a.a linker refers to the amino acid sequence SGGSSGGSSGSETPGTSESAT-PESSGGSSGGSSGGSSGGSSGSETPGTSESAT-PESSGGS SGGS (SEQ ID NO: 687), and the 92 a.a. linker refers to the amino acid sequence PGSPAGSPTSTEEGT-SESATPESGPGTSTEPSEGSAPGSPAGSPTSTEEGT-STEPSEGSAP GTSTEPSEGSAPGTSESATPESGPGSE-PATS (SEQ ID NO: 688).

TABLE 4

| Name | Construct Architecture | Mutations in TadA |
|---|---|---|
| | Plasmid Identity Key | |
| pNMG-142 | pCMV_ecTadA_XTEN_Cas9n_SGGS_NLS | wild-type |
| pNMG-143 | pCMV_ecTadA_XTEN_Cas9n_SGGS_NLS | D108N |
| pNMG-144 | pCMV_ecTadA_XTEN_Cas9n_SGGS_NLS | A106V_D108N |
| pNMG-145 | pCMV_ecTadA_XTEN_Cas9n_SGGS_NLS | D108G |
| pNMG-146 | pCMV_ecTadA_XTEN_Cas9n_SGGS_NLS | R107C_D108N |
| pNMG-147 | pCMV_ecTadA_XTEN_Cas9n_SGGS_NLS | D108V |
| pNMG-155 | pCMV_ecTadA_XTEN_dead Cas9_SGGS_UGI_NLS | D108N |
| pNMG-156 | pCMV_ecTadA_XTEN_nCas9_SGGS_UGI_SGGS_NLS | D108N |
| pNMG-157 | pCMV_ecTadA_XTEN_dead Cas9_SGGS_UGI_SGGS_NLS | D108G |
| pNMG-158 | pCMV_ecTadA_XTEN_nCas9_SGGS_UGI_SGGS_NLS | D108G |
| pNMG-160 | pCMV_ecTadA_XTEN_nCas9_SGGS_AAG*(E125Q)_SGGS_NLS | D108N |
| pNMG-161 | pCMV_ecTadA_XTEN_Cas9n_SGGS_EndoV*(D35A)_NLS | D108N |
| pNMG-162 | pCMV_ecTadA_XTEN_Cas9n_SGGS_NLS | H8Y_D108N_S127S_D147Y_Q154H |
| pNMG-163 | pCMV_ecTadA_XTEN_Cas9n_SGGS_NLS | H8Y_R24W_D108N_N127S_D147Y_E155V |
| pNMG-164 | pCMV_ecTadA_XTEN_Cas9n_SGGS_NLS | D108N_D147Y_E155V |
| pNMG-165 | pCMV_ecTadA_XTEN_Cas9n_SGGS_NLS | H8Y_D108N_S127S |
| pNMG-171 | pCMV_Cas9n_XTEN_ecTadA_SGGS_NLS | wild-type |
| pNMG-172 | pCMV_Cas9n_XTEN_ecTadA_SGGS_NLS | D108N |
| pNMG-173 | pCMV_Cas9n_XTEN_ecTadA_SGGS_NLS | H8Y_D108N_N127S_D147Y_Q154H |
| pNMG-174 | pCMV_Cas9n_XTEN_ecTadA_SGGS_NLS | H8Y_R24W_D108N_N127S_D147Y_E155V |
| pNMG-175 | pCMV_Cas9n_XTEN_ecTadA_SGGS_NLS | D108N_D147Y_E155V |
| pNMG-176 | pCMV_Cas9n_XTEN_ecTadA_SGGS_NLS | H8Y_D108N_S127S |
| pNMG-177 | pCMV_ecTadA_XTEN_Cas9n_SGGS_NLS | A106V_D108N_D147Y_E155V |
| pNMG-178 | pCMV_ecTadA_XTEN_Cas9n_SGGS_UGI_SGGS_NLS | D108N_D147Y_E155V |
| pNMG-179 | pCMV_ecTadA_XTEN_Cas9n_SGGS_AAG*(E125Q)_SGGS_NLS | A106V_D108N_D147Y_E155V |
| pNMG-180 | pCMV_ecTadA_XTEN_Cas9n_SGGS_UGI_SGGS_NLS | A106V_D108N_D147Y_E155V |
| pNMG-181 | pCMV_ecTadA_XTEN_Cas9n_SGGS_AAG*(E125Q)_SGGS_NLS | D108N_D147Y_E155V |
| pNMG-182 | pCMV_ecTadA_SGGS_nCas9_SGGS_NLS | D108N_D147Y_E155V |
| pNMG-183 | pCMV_ecTadA_(SGGS)2-XTEN-(SGGS)2_nCas9_SGGS_NLS | D108N_D147Y_E155V |
| pNMG-235 | pCMV_ecTadA_XTEN_Cas9n_XTEN_AAG*(E125A)_SGGS_NLS | A106V_D108N_D147Y_E155V |
| pNMG-236 | pCMV_ecTadA_XTEN_Cas9n_XTEN_AAG*(E125Q)_SGGS_NLS | A106V_D108N_D147Y_E155V |
| pNMG-237 | pCMV_ecTadA_XTEN_Cas9n_XTEN_AAG*(wt)_SGGS_NLS | A106V_D108N_D147Y_E155V |
| pNMG-238 | pCMV_AAG*(E125A)_XTEN_ecTadA_XTEN_Cas9n_SGGS_NLS | A106V_D108N_D147Y_E155V |
| pNMG-239 | pCMV_AAG*(wt)_XTEN_ecTadA_XTEN_Cas9n_SGGS_NLS | A106V_D108N_D147Y_E155V |
| pNMG-240 | pCMV_ecTadA_XTEN_Cas9n_XTEN_EndoV*(D35A)_SGGS_NLS | A106V_D108N_D147Y_E155V |
| pNMG-241 | pCMV_ecTadA_XTEN_Cas9n_XTEN_EndoV*(wt)_SGGS_NLS | A106V_D108N_D147Y_E155V |
| pNMG-242 | pCMV_EndoV*(D35A)_XTEN_ecTadA_XTEN_Cas9n_SGGS_NLS | A106V_D108N_D147Y_E155V |
| pNMG-243 | pCMV_EndoV*(wt)_XTEN_ecTadA_XTEN_Cas9n_SGGS_NLS | A106V_D108N_D147Y_E155V |
| pNMG-247 | pCMV_ecTadA_XTEN_Cas9 (wild-type)_SGGS_NLS | wild-type |
| pNMG-248 | pCMV_ecTadA_XTEN_Cas9 (wild-type)_SGGS_NLS | D108N_D147Y_E155V |
| pNMG-249 | pCMV_ecTadA_XTEN_Cas9 (wild-type)_SGGS_NLS | A106V_D108N_D147Y_E155V |
| pNMG-250 | pCMV_ecTadA_XTEN_Cas9 (wild-type)_SGGS_UGI_SGGS_NLS | D108N_D147Y_E155V |
| pNMG-251 | pCMV_ecTadA_XTEN_Cas9 (wild-type)_SGGS_AAG*(E125Q)_SGGS_NLS | A106V_D108N_D147Y_E155V |
| pNMG-274 | pCMV_ecTadA_SGGS_NLS (no Cas9 fusion) | wild-type |
| pNMG-275 | pCMV_ecTadA_SGGS_NLS (no Cas9 fusion) | A106V_D108N_D147Y_E155V |
| pNMG-276 | pCMV_ecTadA-(SGGS)2-XTEN-(SGGS)2_ecTadA_XTEN_nCas9_SGGS_NLS | (wild-type) + (wild-type) |
| pNMG-277 | pCMV_ecTadA-(SGGS)2-XTEN-(SGGS)2_ecTadA_XTEN_nCas9_SGGS_NLS | (A106V_D108N_D147Y_E155V) + (A106V_D108N_D147Y_E155V) |
| pNMG-278 | pCMV_ecTadA_XTEN_nCas9_SGGS_NLS | D108Q_D147Y_E155V |
| pNMG-279 | pCMV_ecTadA_XTEN_nCas9_SGGS_NLS | D108M_D147Y_E155V |
| pNMG-280 | pCMV_ecTadA_XTEN_nCas9_SGGS_NLS | D108L_D147Y_E155V |
| pNMG-281 | pCMV_ecTadA_XTEN_nCas9_SGGS_NLS | D108K_D147Y_E155V |
| pNMG-282 | pCMV_ecTadA_XTEN_nCas9_SGGS_NLS | D108I_D147Y_E155V |

TABLE 4-continued

Plasmid Identity Key

| Name | Construct Architecture | Mutations in TadA |
|---|---|---|
| pNMG-283 | pCMV_ecTadA_XTEN_nCas9_SGGS_NLS | D108F_D147Y_E155V |
| pNMG-284 | pCMV_ecTadA_LONGER LINKER (92 a.a.)_ecTadA_XTEN_nCas9_SGGS_NLS | (wild-type) + (A106V_D108N_D147Y_E155V) |
| pNMG-285 | pCMV_ecTadA_LONGER LINKER (92 a.a.)_ecTadA_XTEN_nCas9_SGGS_NLS | (A106V_D108N_D147Y_E155V) + (A106V_D108N_D147Y) |
| pNMG-285b | pCMV_ecTadA_LONGER LINKER (92 a.a.)_ecTadA_XTEN_nCas9_SGGS_NLS | (A106V_D108N_D147Y_E155V) + (A106V_D108N_D147Y_E155V) |
| pNMG-286 | pCMV_ecTadA_XTEN_nCas9_SGGS_NLS | A106V_D108M_D147Y_E155V |
| pNMG-287 | pCMV_ecTadA-(SGGS)2-XTEN-(SGGS)2_ecTadA_XTEN-nCas9 (S. aureus)_SGGS_NLS | (A106V_D108N_D147Y_E155V) + (A106V_D108N_D147Y_E155V) |
| pNMG-289 | pCMV_ecTadA-(SGGS)2-XTEN-(SGGS)2_ecTadA_XTEN_nCas9_SGGS_UGI_NLS | (A106V_D108N_D147Y_E155V) + (A106V_D108N_D147Y_E155V) |
| pNMG-290 | pCMV_ecTadA-(SGGS)2-XTEN-(SGGS)2_ecTadA_(SGGS)2-XTEN-(SGGS)2_nCas9_SGGS_UGI_NLS | (A106V_D108N_D147Y_E155V) + (A106V_D108N_D147Y_E155V) |
| pNMG-293 | pCMV_ecTadA_XTEN_Cas9n_SGGS_NLS | E59A_A106V_D108N_D147Y_E155V |
| pNMG-294 | pCMV_ecTadA_XTEN_Cas9n_SGGS_NLS | E59A |
| pNMG-295 | pCMV_ecTadA_SGGS_NLS (no Cas9 fusion) | E59A |
| pNMG-296 | pCMV_ecTadA_SGGS_NLS (no Cas9 fusion) | E59A cat dead_A106V_D108N_D147Y_E155V |
| pNMG-297 | pCMV_ecTadA-(SGGS)2-XTEN-(SGGS)2_ecTadA_XTEN_nCas9_SGGS_NLS | (A106V_D108N_D147Y_E155V) + (wild-type) |
| pNMG-298 | pCMV_ecTadA-(SGGS)2-XTEN-(SGGS)2_ecTadA_XTEN_nCas9_SGGS_NLS | (D108M_D147Y_E155V) + (D108M_D147Y_E155V) |
| pNMG-320 | pCMV_ecTadA-(SGGS)2-XTEN-(SGGS)2_ecTadA_XTEN_nCas9_SGGS_NLS | (wild-type) + (A106V_D108N_D147Y_E155V) |
| pNMG-321 | pCMV_ecTadA-(SGGS)2-XTEN-(SGGS)2_ecTadA_XTEN_nCas9_SGGS_NLS | (E59A_A106V_D108N_D147Y_E155V) + (A106V_D108N_D147Y_E155V) |
| pNMG-322 | pCMV_ecTadA-(SGGS)2-XTEN-(SGGS)2_ecTadA_XTEN_nCas9_SGGS_NLS | (A106V_D108N_D147Y_E155V) + (E59A_A106V_D108N_D147Y_E155V) |
| pNMG-335 | pCMV_TadA3p-XTEN-TadA2p-XTEN-nCas9-NLS | wild-type |
| pNMG-336 | pCMV_ecTadA_(SGGS)2-XTEN-(SGGS)2_nCas9_SGGS_UGI_SGGS_NLS | L84F_A106V_D108N_H123Y_D147Y_E155V_I156Y |
| pNMG-337 | pCMV_ecTadA_(SGGS)2-XTEN-(SGGS)2_nCas9_SGGS_UGI_SGGS_NLS | A106V_D108N_D147Y_E155V |
| pNMG-338 | pCMV_ecTadA_(SGGS)2-XTEN-(SGGS)2_nCas9_SGGS_UGI_SGGS_NLS | L84F_A106V_D108N_H123Y_D147Y_E155V_I156F |
| pNMG-339 | pCMV_ecTadA-(SGGS)2-XTEN-(SGGS)2_ecTadA_(SGGS)2-XTEN-(SGGS)2_nCas9_SGGS_UGI_SGGS_NLS | (L84F_A106V_D108N_H123Y_D147Y_E155V_I156Y) + (L84F_A106V_D108N_H123Y_D147Y_E155V_I156Y) |
| pNMG-340 | pCMV_ecTadA-(SGGS)2-XTEN-(SGGS)2_ecTadA_(SGGS)2-XTEN-(SGGS)2_nCas9_SGGS_UGI_SGGS_NLS | (A106V_D108N_D147Y_E155V) + (A106V_D108N_D147Y_E155V) |
| pNMG-341 | pCMV_ecTadA-(SGGS)2-XTEN-(SGGS)2_ecTadA_(SGGS)2-XTEN-(SGGS)2_nCas9_SGGS_UGI_SGGS_NLS | (L84F_A106V_D108N_H123Y_D147Y_E155V_I156F) + (L84F_A106V_D108N_H123Y_D147Y_E155V_I156F) |
| pNMG-345 | pCMV_S. aureusTadA-(SGGS)2-XTEN-(SGGS)2-S. aureusTadA-(SGGS)2-XTEN-(SGGS)2-nCas9_SGGS_NLS | wild-type |
| pNMG-346 | pCMV_S. aureusTadA-(SGGS)2-XTEN-(SGGS)2-S. aureusTadA-(SGGS)2-XTEN-(SGGS)2-nCas9_SGGS_NLS | (D108N) + (D108N) |
| pNMG-347 | pCMV_S. aureusTadA-(SGGS)2-XTEN-(SGGS)2-S. aureusTadA-(SGGS)2-XTEN-(SGGS)2-nCas9_SGGS_NLS | (D107A_D018N) + (D107A_D108N) |
| pNMG-348 | pCMV_S. aureusTadA-(SGGS)2-XTEN-(SGGS)2-S. aureusTadA-(SGGS)2-XTEN-(SGGS)2-nCas9_SGGS_NLS | (G26P_D107A_D108N) + (G26P_D107A_D108N) |
| pNMG-349 | pCMV_S. aureusTadA-(SGGS)2-XTEN-(SGGS)2-S. aureusTadA-(SGGS)2-XTEN-(SGGS)2-nCas9_sGGS_NLS | (G26P_D107A_D108N_S142A) + (G26P_D107A_D108N_S142A) |
| pNMG-350 | pCMV_S. aureusTadA-(SGGS)2-XTEN-(SGGS)2-S. aureusTadA-(SGGS)2-XTEN-(SGGS)2-nCas9_SGGS_NLS | (D104A_D108N_S142A) + (D107A_D108N_S142A) |
| pNMG-351 | pCMV_ecTadA_(SGGS)2-XTEN-(SGGS)2_nCas9_SGGS_NLS | (R26G_L84F_A106V_R107H_D108N_H123Y_A142N_A143D_D147Y_E155V_I156F) |
| pNMG-352 | pCMV_ecTadA_(SGGS)2-XTEN-(SGGS)2_nCas9_SGGS_NLS | (E25G_R26G_L84F_A106V_R107H_D108N_H123Y_A142N_A143D_D147Y_E155V_I156F) |
| pNMG-353 | pCMV_ecTadA_(SGGS)2-XTEN-(SGGS)2_nCas9_SGGS_NLS | (E25D_R26G_L84F_A106V_R107K_D108N_H123Y_A142N_A143D_D147Y_E155V_I156F) |
| pNMG-354 | pCMV_ecTadA_(SGGS)2-XTEN-(SGGS)2_nCas9_SGGS_NLS | (R26Q_L84F_A106V_D108N_H123Y_A142N_D147Y_E155V_I156F) |
| pNMG-355 | pCMV_ecTadA_(SGGS)2-XTEN-(SGGS)2_nCas9_SGGS_NLS | (E25M_R26G_L84F_A106V_R107P_D108N_H123Y_A142N_A143D_D147Y_E155V_I156F) |
| pNMG-356 | pCMV_ecTadA_(SGGS)2-XTEN-(SGGS)2_nCas9_SGGS_NLS | (R26C_L84F_A106V_R107H_D108N_H123Y_A142N_D147Y_E155V_I156F) |

TABLE 4-continued

Plasmid Identity Key

| Name | Construct Architecture | Mutations in TadA |
|---|---|---|
| pNMG-357 | pCMV_ecTadA_(SGGS)2-XTEN-(SGGS)2_nCas9_SGGS_NLS | (L84F_A106V_D108N_H123Y_A142N_A143L_D147Y_E155V_I156F) |
| pNMG-358 | pCMV_ecTadA_(SGGS)2-XTEN-(SGGS)2_nCas9_SGGS_NLS | (R26G_L84F_A106V_D108N_H123Y_A142N_D147Y_E155V_I156F) |
| pNMG-359 | pCMV_ecTadA_(SGGS)2-XTEN-(SGGS)2_nCas9_SGGS_NLS | (E25A_R26G_L84F_A106V_R107N_D108N_H123Y_A142N_A143D_D147Y_E155V_I156F) |
| pNMG-360 | pCMV_ecTadA-(SGGS)2-XTEN-(SGGS)2-ecTadA-(SGGS)2-XTEN-(SGGS)2_nCas9_SGGS_NLS | (R26G_L84F_A106V_R107H_D108N_H123Y_A142N_A143D_D147Y_E155V_I156F) + (R26G_L84F_A106V_R107H_D108N_H123Y_A142N_A143D_D147Y_E155V_I156F) |
| pNMG-361 | pCMV_ecTadA-(SGGS)2-XTEN-(SGGS)2-ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) × 2 |
| pNMG-362 | pCMV_ecTadA-(SGGS)2-XTEN-(SGGS)2-ecTadA-(SGGS)2-XTEN-(SGGS)2_nCas9_SGGS_NLS | (E25D_R26G_L84F_A106V_R107K_D108N_H123Y_A142N_A143G_D147Y_E155V_I156F) × 2 |
| pNMG-363 | pCMV_ecTadA-(SGGS)2-XTEN-(SGGS)2-ecTadA-(SGGS)2-XTEN-(SGGS)2_nCas9_SGGS_NLS | (R26Q_L84F_A106V_D108N_H123Y_A142N_D147Y_E155V_I156F) × 2 |
| pNMG-364 | pCMV_ecTadA-(SGGS)2-XTEN-(SGGS)2-ecTadA-(SGGS)2-XTEN-(SGGS)2_nCas9_SGGS_NLS | (E25M_R26G_L84F_A106V_R107P_D108N_H123Y_A142N_A143D_D147Y_E155V_I156F) × 2 |
| pNMG-365 | pCMV_ecTadA-(SGGS)2-XTEN-(SGGS)2-ecTadA-(SGGS)2-XTEN-(SGGS)2_nCas9_SGGS_NLS | (R26C_L84F_A106V_R107H_D108N_H123Y_A142N_D147Y_E155V_I156F) × 2 |
| pNMG-366 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_A143L_D147Y_E155V_I156F) × 2 |
| pNMG-367 | pCMV_ecTadA-(SGGS)2-XTEN-(SGGS)2-ecTadA-(SGGS)2-XTEN-(SGGS)2_nCas9_SGGS_NLS | (R26G_L84F_A106V_D108N_H123Y_A142N_D147Y_E155V_I156F) × 2 |
| pNMG-368 | pCMV_ecTadA-(SGGS)2-XTEN-(SGGS)2-ecTadA-(SGGS)2-XTEN-(SGGS)2_nCas9_SGGS_NLS | (E25A_R26G_L84F_A106V_R107N_D108N_H123Y_A142N_A143E_D147Y_E155V_I156F) × 2 |
| pNMG-369 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156Y) + (L84F_A106V_D108N_H123Y_D147Y_E155V_I156Y) |
| pNMG-370 | pCMV_ecTadA-(SGGS)2-XTEN-(SGGS)2-ecTadA-(SGGS)2-XTEN-(SGGS)2_nCas9_SGGS_NLS | (A106V_D108N_D147Y_E155V) + (A106V_D108N_D147Y_E155V) |
| pNMG-371 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (L84F_A106V_D108N_H123Y_D147Y_E155V_I156F) |
| pNMG-372 | pCMV_ecTadA_(SGGS)2-XTEN-(SGGS)2_Cas9n_SGGS_NLS | A106V_D108N_A142N_D147Y_E155V |
| pNMG-373 | pCMV_ecTadA_(SGGS)2-XTEN-(SGGS)2_Cas9n_SGGS_NLS | R26G_A106V_D108N_A142N_D147Y_E155V |
| pNMG-374 | pCMV_ecTadA_(SGGS)2-XTEN-(SGGS)2_Cas9n_SGGS_NLS | E25D_R26G_A106V_R107K_D108N_A142N_A143G_D147Y_E155V |
| pNMG-375 | pCMV_ecTadA_(SGGS)2-XTEN-(SGGS)2_Cas9n_SGGS_NLS | R26G_A106V_D108N_R107H_A142N_A143D_D147Y_E155V |
| pNMG-376 | pCMV_ecTadA_(SGGS)2-XTEN-(SGGS)2_Cas9n_SGGS_NLS | E25D_R26G_A106V_D108N_A142N_D147Y_E155V |
| pNMG-377 | pCMV_ecTadA_(SGGS)2-XTEN-(SGGS)2_Cas9n_SGGS_NLS | A106V_R107K_D108N_A142N_D147Y_E155V |
| pNMG-378 | pCMV_ecTadA_(SGGS)2-XTEN-(SGGS)2_Cas9n_SGGS_NLS | A106V_D108N_A142N_A143G_D147Y_E155V |
| pNMG-379 | pCMV_ecTadA_(SGGS)2-XTEN-(SGGS)2_Cas9n_SGGS_NLS | A106V_D108N_A142N_A143L_D147Y_E155V |
| pNMG-382 | pCMV_ecTadA-(SGGS)2-XTEN-(SGGS)2-ecTadA-(SGGS)2-XTEN-(SGGS)2_nCas9_SGGS_NLS | A106V_D108N_A142N_D147Y_E155V × 2 |
| pNMG-383 | pCMV_ecTadA-(SGGS)2-XTEN-(SGGS)2-ecTadA-(SGGS)2-XTEN-(SGGS)2_nCas9_SGGS_NLS | R26G_A106V_D108N_A142N_D147Y_E155V × 2 |
| pNMG-384 | pCMV_ecTadA-(SGGS)2-XTEN-(SGGS)2-ecTadA-(SGGS)2-XTEN-(SGGS)2_nCas9_SGGS_NLS | E25D_R26G_A106V_R107K_D108N_A142N_A143G_D147Y_E155V × 2 |
| pNMG-385 | pCMV_ecTadA-(SGGS)2-XTEN-(SGGS)2-ecTadA-(SGGS)2-XTEN-(SGGS)2_nCas9_SGGS_NLS | R26G_A106V_D108N_R107H_A142N_A143D_D147Y_E155V × 2 |
| pNMG-386 | pCMV_ecTadA-(SGGS)2-XTEN-(SGGS)2-ecTadA-(SGGS)2-XTEN-(SGGS)2_nCas9_SGGS_NLS | E25D_R26G_A106V_D108N_A142N_D147Y_E155V × 2 |
| pNMG-387 | pCMV_ecTadA-(SGGS)2-XTEN-(SGGS)2-ecTadA-(SGGS)2-XTEN-(SGGS)2_nCas9_SGGS_NLS | A106V_R107K_D108N_A142N_D147Y_E155V × 2 |
| pNMG-388 | pCMV_ecTadA-(SGGS)2-XTEN-(SGGS)2-ecTadA-(SGGS)2-XTEN-(SGGS)2_nCas9_SGGS_NLS | A106V_D108N_A142N_A143G_D147Y_E155V × 2 |
| pNMG-389 | pCMV_ecTadA-(SGGS)2-XTEN-(SGGS)2-ecTadA-(SGGS)2-XTEN-(SGGS)2_nCas9_SGGS_NLS | A106V_D108N_A142N_A143L_D147Y_E155V × 2 |
| pNMG-391 | pCMV_ecTadA_(SGGS)2-XTEN-(SGGS)2_Cas9n_SGGS_UGI_SGGS_NLS | H36L_R51L_L84F_A106V_D108N_H123Y_S146C_D147Y_E155V_I156F_K157N |
| pNMG-392 | pCMV_ecTadA_(SGGS)2-XTEN-(SGGS)2_Cas9n_SGGS_UGI_SGGS_NLS | N37T_P48T_M70L_L84F_A106V_D108N_H123Y_D147Y_I49V_E155V_I156F |
| pNMG-393 | pCMV_ecTadA_(SGGS)2-XTEN-(SGGS)2_Cas9n_SGGS_UG1_SGGS_NLS | N37S_L84F_A106V_D108N_H123Y_D147Y_E155V_I156F_K161T |
| pNMG-394 | pCMV_ecTadA_(SGGS)2-XTEN-(SGGS)2_Cas9n_SGGS_UG1_SGGS_NLS | H36L_L84F_A106V_D108N_H123Y_D147Y_Q154H_E155V_I156F |
| pNMG-395 | pCMV_ecTadA_(SGGS)2-XTEN-(SGGS)2_Cas9n_SGGS_UG1_SGGS_NLS | N72S_L84F_A106V_D108N_H123Y_S146R_D147Y_E155V_I156F |
| pNMG-396 | pCMV_ecTadA_(SGGS)2-XTEN-(SGGS)2_Cas9n_SGGS_UG1_SGGS_NLS | H36L_P48L_L84F_A106V_D108N_H123Y_E134G_D147Y_E155V_I156F |

TABLE 4-continued

Plasmid Identity Key

| Name | Construct Architecture | Mutations in TadA |
|---|---|---|
| pNMG-397 | pCMV_ecTadA_(SGGS)2-XTEN-(SGGS)2_Cas9n_SGGS_UG1_SGGS_NLS | H36L_L84F_A106V_D108N_H123Y_D147Y_E155V_I156F_K157N |
| pNMG-398 | pCMV_ecTadA_(SGGS)2-XTEN-(SGGS)2_Cas9n_SGGS_UG1_SGGS_NLS | H36L_L84F_A106V_D108N_H123Y_S146C_D147Y_E155V_I156F |
| pNMG-399 | pCMV_ecTadA_(SGGS)2-XTEN-(SGGS)2_Cas9n_SGGS_UG1_SGGS_NLS | L84F_A106V_D108N_H123Y_S146R_D147Y_E155V_I156F_K161T |
| pNMG-400 | pCMV_ecTadA_(SGGS)2-XTEN-(SGGS)2_Cas9n_SGGS_UG1_SGGS_NLS | N37S_R51H_D77G_L84F_A106V_D108N_H123Y_D147Y_E155V_I156F |
| pNMG-401 | pCMV_ecTadA_(SGGS)2-XTEN-(SGGS)2_Cas9n_SGGS_UG1_SGGS_NLS | R51L_L84F_A106V_D108N_H123Y_D147Y_E155V_I156F_K157N |
| pNMG-402 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) × 2 |
| pNMG-403 | pCMV_ecTadA-(SGGS)2-XTEN-(SGGS)2-ecTadA-(SGGS)2-XTEN-(SGGS)2_nCas9_SGGS_NLS | (N37T_P48T_M70L_L84F_A106V_D108N_H123Y_D147Y_I49V_E155V_I156F) × 2 |
| pNMG-404 | pCMV_ecTadA-(SGGS)2-XTEN-(SGGS)2-ecTadA-(SGGS)2-XTEN-(SGGS)2_nCas9_SGGS_NLS | (N37S_L84F_A106V_D108N_H123Y_D147Y_E155V_I156F_K161T) × 2 |
| pNMG-405 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_Q154H_E155V_I156F) × 2 |
| pNMG-406 | pCMV_ecTadA-(SGGS)2-XTEN-(SGGS)2-ecTadA-(SGGS)2-XTEN-(SGGS)2_nCas9_SGGS_NLS | (N72S_L84F_A106V_D108N_H123Y_S146R_D147Y_E155V_I156F) × 2 |
| pNMG-407 | pCMV_ecTadA-(SGGS)2-XTEN-(SGGS)2-ecTadA-(SGGS)2-XTEN-(SGGS)2_nCas9_SGGS_NLS | (H36L_P48L_L84F_A106V_D108N_H123Y_E134G_D147Y_E155V_I156F) × 2 |
| pNMG-408 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_E155V_I156F_K157N) × 2 |
| pNMG-409 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_S146C_D147Y_E155V_I156F) × 2 |
| pNMG-410 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_S146R_D147Y_E155V_I156F_K161T) × 2 |
| pNMG-411 | pCMV_ecTadA-(SGGS)2-XTEN-(SGGS)2-ecTadA-(SGGS)2-XTEN-(SGGS)2_nCas9_SGGS_NLS | (N37S_R51H_D77G_L84F_A106V_D108N_H123Y_D147Y_E155V_I156F) × 2 |
| pNMG-412 | pCMV_ecTadA-(SGGS)2-XTEN-(SGGS)2-ecTadA-(SGGS)2-XTEN-(SGGS)2_nCas9_SGGS_NLS | (R51L_L84F_A106V_D108N_H123Y_D147Y_E155V_I156F_K157N) × 2 |
| pNMG-440 | pCMV_ecTadA_(SGGS)2-XTEN-(SGGS)2_Cas9n_SGGS_UG1_SGGS_NLS | D24G_Q71R_L84F_H96L_A106V_D108N_H123Y_D147Y_E155V_I156F_K160E |
| pNMG-441 | pCMV_ecTadA_(SGGS)2-XTEN-(SGGS)2_Cas9n_SGGS_UG1_SGGS_NLS | H36L_G67V_L84F_A106V_D108N_H123Y_S146T_D147Y_E155V_I156F |
| pNMG-442 | pCMV_ecTadA_(SGGS)2-XTEN-(SGGS)2_Cas9n_SGGS_UG1_SGGS_NLS | Q71L_L84F_A106V_D108N_H123Y_L137M_A143E_D147Y_E155V_I156F |
| pNMG-443 | pCMV_ecTadA_(SGGS)2-XTEN-(SGGS)2_Cas9n_SGGS_UG1_SGGS_NLS | E25G_L84F_A106V_D108N_H123Y_D147Y_E155V_I156F_Q159L |
| pNMG-444 | pCMV_ecTadA_(SGGS)2-XTEN-(SGGS)2_Cas9n_SGGS_UG1_SGGS_NLS | L84F_A91T_F104I_A106V_D108N_H123Y_D147Y_E155V_I156F |
| pNMG-445 | pCMV_ecTadA_(SGGS)2-XTEN-(SGGS)2_Cas9n_SGGS_UG1_SGGS_NLS | N72D_L84F_A106V_D108N_H123Y_G125A_D147Y_E155V_I156F |
| pNMG-446 | pCMV_ecTadA_(SGGS)2-XTEN-(SGGS)2_Cas9n_SGGS_UG1_SGGS_NLS | P48S_L84F_S97C_A106V_D108N_H123Y_D147Y_E155V_I156F |
| pNMG-447 | pCMV_ecTadA_(SGGS)2-XTEN-(SGGS)2_Cas9n_SGGS_UG1_SGGS_NLS | W23G_L84F_A106V_D108N_H123Y_D147Y_E155V_I156F |
| pNMG-448 | pCMV_ecTadA_(SGGS)2-XTEN-(SGGS)2_Cas9n_SGGS_UG1_SGGS_NLS | D24G_P48L_Q71R_L84F_A106V_D108N_H123Y_D147Y_E155V_I156F_Q159L |
| pNMG-449 | pCMV_ecTadA-(SGGS)2-XTEN-(SGGS)2-ecTadA-(SGGS)2-XTEN-(SGGS)2_nCas9_SGGS_NLS | (D24G_Q71R_L84F_H96L_A106V_D108N_H123Y_D147Y_E155V_I156F_K160E) × 2 |
| pNMG-450 | pCMV_ecTadA-(SGGS)2-XTEN-(SGGS)2-ecTadA-(SGGS)2-XTEN-(SGGS)2_nCas9_SGGS_NLS | (H36L_G67V_L84F_A106V_D108N_H123Y_S146T_D147Y_E155V_I156F) × 2 |
| pNMG-451 | pCMV_ecTadA-(SGGS)2-XTEN-(SGGS)2-ecTadA-(SGGS)2-XTEN-(SGGS)2_nCas9_SGGS_NLS | (Q71L_L84F_A106V_D108N_H123Y_L137M_A143E_D147Y_E155V_I156F) × 2 |
| pNMG-452 | pCMV_ecTadA-(SGGS)2-XTEN-(SGGS)2-ecTadA-(SGGS)2-XTEN-(SGGS)2_nCas9_SGGS_NLS | (E25G_L84F_A106V_D108N_H123Y_D147Y_E155V_I156F_Q159L) × 2 |
| pNMG-453 | pCMV_ecTadA-(SGGS)2-XTEN-(SGGS)2-ecTadA-(SGGS)2-XTEN-(SGGS)2_nCas9_SGGS_NLS | (L84F_A91T_F104I_A106V_D108N_H123Y_D147Y_E155V_I156F) × 2 |
| pNMG-454 | pCMV_ecTadA-(SGGS)2-XTEN-(SGGS)2-ecTadA-(SGGS)2-XTEN-(SGGS)2_nCas9_SGGS_NLS | (N72D_L84F_A106V_D108N_H123Y_G125A_D147Y_E155V_I156F) × 2 |
| pNMG-455 | pCMV_ecTadA-(SGGS)2-XTEN-(SGGS)2-ecTadA-(SGGS)2-XTEN-(SGGS)2_nCas9_SGGS_NLS | (P48S_L84F_S97C_A106V_D108N_H123Y_D147Y_E155V_I156F) × 2 |
| pNMG-456 | pCMV_ecTadA-(SGGS)2-XTEN-(SGGS)2-ecTadA-(SGGS)2-XTEN-(SGGS)2_nCas9_SGGS_NLS | (W23G_L84F_A106V_D108N_H123Y_D147Y_E155V_I156F) × 2 |
| pNMG-457 | pCMV_ecTadA-(SGGS)2-XTEN-(SGGS)2-ecTadA-(SGGS)2-XTEN-(SGGS)2_nCas9_SGGS_NLS | (D24G_P48L_Q71R_L84F_A106V_D108N_H123Y_D147Y_E155V_I156F_Q159L) × 2 |
| pNMG-473 | pCMV_ecTadA_(SGGS)2-XTEN-(SGGS)2_Cas9n_SGGS_UGI_SGGS_NLS | L84F_A106V_D108N_H123Y_A142N_D147Y_E155V_I156F |
| pNMG-474 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_D147Y_E155V_I156F) × 2 |
| pNMG-475 | pCMV_ecTadA-(SGGS)2-XTEN-(SGGS)2-ecTadA-(SGGS)2-XTEN-(SGGS)2_nCas9_SGGS_NLS | (wild-typet) + (A106V_D108N_D147Y_E155V) |
| pNMG-476 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_D147Y_E155V_I156F) |

TABLE 4-continued

Plasmid Identity Key

| Name | Construct Architecture | Mutations in TadA |
|---|---|---|
| pNMG-477 | pCMV_ecTadA-(SGGS)2-XTEN-(SGGS)2-ecTadA-(SGGS)2-XTEN-(SGGS)2_nCas9_SGGS_NLS | (wild-type) + (H36L_R51L_L84F_A106V_D108N_H123Y_S146C_D147Y_E155V_I156F_K157N) |
| pNMG-478 | pCMV_ecTadA-(SGGS)2-XTEN-(SGGS)2-ecTadA-(SGGS)2-XTEN-(SGGS)2_nCas9_SGGS_NLS | (wild-type) + (N37S_L84F_A106V_D108N_H123Y_D147Y_E155V_I156F_K161T) |
| pNMG-479 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_S146R_D147Y_E155V_I156F_K161T) |
| pNMG-480 | pCMV_ecTadA_(SGGS)2-XTEN-(SGGS)2_Cas9n_SGGS_NLS | wild-type |
| pNMG-481 | pCMV_ecTadA_(SGGS)2-XTEN-(SGGS)2_Cas9n_SGGS_NLS | A106V_D108N |
| pNMG-482 | pCMV_ecTadA-(SGGS)2-XTEN-(SGGS)2-ecTadA-(SGGS)2-XTEN-(SGGS)2_nCas9_SGGS_NLS | wild-type + wild-type |
| pNMG-483 | pCMV_ecTadA-(SGGS)2-XTEN-(SGGS)2-ecTadA-(SGGS)2-XTEN-(SGGS)2_nCas9_SGGS_NLS | (A106V_D108N) x2 |
| pNMG-484 | pCMV_ecTadA-(SGGS)2-XTEN-(SGGS)2-ecTadA-(SGGS)2-XTEN-(SGGS)2_nCas9_SGGS_NLS | wild-type + (A106V_D108N) |
| pNMG-485 | pCMV_ecTadA-(SGGS)2-XTEN-(SGGS)2_nCas9_SGGS_UGI_SGGS_NLS | H36L_R51L_L84F_A106V_D108N_H123Y_A142N_S146C_D147Y_E155V_I156F_K157N |
| pNMG-486 | pCMV_ecTadA-(SGGS)2-XTEN-(SGGS)2_nCas9_SGGS_UGI_SGGS_NLS | N37S_L84F_A106V_D108N_H123Y_A142N_D147Y_E155V_I156F_K161T |
| pNMG-487 | pCMV_ecTadA-(SGGS)2-XTEN-(SGGS)2_nCas9_SGGS_UGI_SGGS_NLS | L84F_A106V_D108N_D147Y_E155V_I156F |
| pNMG-488 | pCMV_ecTadA-(SGGS)2-XTEN-(SGGS)2_nCas9_SGGS_UGI_SGGS_NLS | R51L_L84F_A106V_D108N_H123Y_S146C_D147Y_E155V_I156F_K157N_K161T |
| pNMG-489 | pCMV_ecTadA-(SGGS)2-XTEN-(SGGS)2_nCas9_SGGS_UGI_SGGS_NLS | L84F_A106V_D108N_H123Y_S146C_D147Y_E155V_I156F_K161T |
| pNMG-490 | pCMV_ecTadA-(SGGS)2-XTEN-(SGGS)2_nCas9_SGGS_UGI_SGGS_NLS | L84F_A106V_D108N_H123Y_S146C_D147Y_E155V_I156F_K157N_K160E_K161T |
| pNMG-491 | pCMV_ecTadA-(SGGS)2-XTEN-(SGGS)2_nCas9_SGGS_UGI_SGGS_NLS | L84F_A106V_D108N_H123Y_S146C_D147Y_E155V_I156F_K157N_K160E |
| pNMG-492 | pCMV_ecTadA-(SGGS)2-XTEN-(SGGS)2-ecTadA-(SGGS)2-XTEN(SGGS)2_nCas9_SGGS_NLS | (wt) + (L84F_A106V_D108N_H123Y_A142N_D147Y_E155V_I156F) |
| pNMG-493 | pCMV_ecTadA-(SGGS)2-XTEN-(SGGS)2-ecTadA-(SGGS)2-XTEN(SGGS)2_nCas9_SGGS_NLS | (wt) + (D24G_Q71R_L84F_H96L_A106V_D108N_H123Y_D147Y_E155V_I156F_K160E) |
| pNMG-494 | pCMV_ecTadA-(SGGS)2-XTEN-(SGGS)2-ecTadA-(SGGS)2-XTEN(SGGS)2_nCas9_SGGS_NLS | (wt) + (H36L_R51L_L84F_A106V_D108N_H123Y_A142N_S146C_D147Y_E155V_I156F_K157N) |
| pNMG-495 | pCMV_ecTadA-(SGGS)2-XTEN-(SGGS)2-ecTadA-(SGGS)2-XTEN(SGGS)2_nCas9_SGGS_NLS | (wt) + (N37S_L84F_A106V_D108N_H123Y_A142N_D147Y_E155V_I156F_K161T) |
| pNMG-496 | pCMV_ecTadA-(SGGS)2-XTEN-(SGGS)2-ecTadA-(SGGS)2-XTEN(SGGS)2_nCas9_SGGS_NLS | (wt) + (L84F_A106V_D108N_D147Y_E155V_I156F) |
| pNMG-497 | pCMV_ecTadA-(SGGS)2-XTEN-(SGGS)2-ecTadA-(SGGS)2-XTEN(SGGS)2_nCas9_SGGS_NLS | (wt) + (R51L_L84F_A106V_D108N_H123Y_S146C_D147Y_E155V_I156F_K161T) |
| pNMG-498 | pCMV_ecTadA-(SGGS)2-XTEN-(SGGS)2-ecTadA-(SGGS)2-XTEN(SGGS)2_nCas9_SGGS_NLS | (wt) + (L84F_A106V_D108N_H123Y_S146C_D147Y_E155V_I156F_K161T) |
| pNMG-499 | pCMV_ecTadA-(SGGS)2-XTEN-(SGGS)2-ecTadA-(SGGS)2-XTEN(SGGS)2_nCas9_SGGS_NLS | (wt) + (L84F_A106V_D108N_H123Y_S146C_D147Y_E155V_I156F_K157N_K160E_K161T) |
| pNMG-500 | pCMV_ecTadA-(SGGS)2-XTEN-(SGGS)2-ecTadA-(SGGS)2-XTEN(SGGS)2_nCas9_SGGS_NLS | (wt) + (L84F_A106V_D108N_H123Y_S146C_D147Y_E155V_I156F_K157N_K160E) |
| pNMG-513 | pCMV_ecTadA-92 a.a.-ecTadA-32 a.a._nCas9_SGGS_NLS | (wt) + (L84F_A106V_D108N_H123Y_D147Y_E155V_I156F) |
| pNMG-514 | pCMV_ecTadA-92 a.a.-ecTadA-32 a.a._nCas9_SGGS_NLS | (wt) + (L84F_A106V_D108N_H123Y_D147Y_E155V_I156F) + (L84F_A106V_D108N_H123Y_D147Y_E155V_I156F) |
| pNMG-515 | pCMV_ecTadA-92 a.a.-ecTadA-64 a.a._nCas9_SGGS_NLS | (wt) + (L84F_A106V_D108N_H123Y_D147Y_E155V_I156F) |
| pNMG-516 | pCMV_ecTadA-92 a.a.-ecTadA-64 a.a._nCas9_SGGS_NLS | (wt) + (L84F_A106V_D108N_H123Y_D147Y_E155V_I156F) + (L84F_A106V_D108N_H123Y_D147Y_E155V_I156F) |
| pNMG-517 | pCMV_ecTadA-92 a.a.-ecTadA-64 a.a._nCas9_SGGS_NLS | (wt) + (L84F_A106V_D108N_H123Y_D147Y_E155V_I156F) |
| pNMG-518 | pCMV_ecTadA-32 a.a.-ecTadA-64 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-519 | pCMV_ecTadA-32 a.a._nCas9_SGGS_NLS | R74Q |
| pNMG-520 | pCMV_ecTadA-32 a.a._nCas9_SGGS_NLS | R74Q L84F_A106V_D108N_H123Y_D147Y_E155V_I156F |

TABLE 4-continued

Plasmid Identity Key

| Name | Construct Architecture | Mutations in TadA |
|---|---|---|
| pNMG-521 | pCMV_ecTadA-32 a.a.-_nCas9_SGGS_NLS | R74A_L84F_A106V_D108N_H123Y_D147Y_E155V_I156F |
| pNMG-522 | pCMV_ecTadA-32 a.a.-_nCas9_SGGS_NLS | R98Q |
| pNMG-523 | pCMV_ecTadA-32 a.a.-_nCas9_SGGS_NLS | R129Q |
| pNMG-524 | pCMV_ecTadA-(SGGS)2-XTEN-(SGGS)2-ecTadA-(SGGS)2-XTEN-(SGGS)2_nCas9_SGGS_NLS | (wt + R74Q) + (L84F_A106V_D108N_H123Y_D147Y_E155V_I156F) |
| pNMG-525 | pCMV_ecTadA-(SGGS)2-XTEN-(SGGS)2-ecTadA-(SGGS)2-XTEN-(SGGS)2_nCas9_SGGS_NLS | (wt + R74Q) + (R74Q_L84F_A106V_D108N_H123Y_D147Y_E155V_I156F) |
| pNMG-526 | pCMV_ecTadA-(SGGS)2-XTEN-(SGGS)2-ecTadA-(SGGS)2-XTEN-(SGGS)2_nCas9_SGGS_NLS | (R74A_L84F_A106V_D108N_H123Y_D147Y_E155V_I156F) + (R74A_L84F_A106V_D108N_H123Y_D147Y_E155V_I156F) |
| pNMG-527 | pCMV_ecTadA-(SGGS)2-XTEN-(SGGS)2-ecTadA-(SGGS)2-XTEN-(SGGS)2_nCas9_SGGS_NLS | (wt + R98Q) + (L84F_R98Q_A106V_D108N_H123Y_D147Y_E155V_I156F) |
| pNMG-528 | pCMV_ecTadA-(SGGS)2-XTEN-(SGGS)2-ecTadA-(SGGS)2-XTEN-(SGGS)2_nCas9_SGGS_NLS | (wt + R129Q) + (L84F_A106V_D108N_H123Y_R129Q_D147Y_E155V_I156F) |
| pNMG-529 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (H36L_R51L_L84F_A106V_D108N_H123Y_S146C_D147Y_E155V_I156F_K157N) |
| pNMG-530 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) + (L84F_A106V_D108N_H123Y_D147Y_E155V_I156F) |
| pNMG-543 | pCMV_ecTadA-(SGGS)2-XTEN-(SGGS)2_nCas9_SGGS_NLS | (P48S_L84F_A106V_D108N_H123Y_A142N_D147Y_E155V_I156F) |
| pNMG-544 | pCMV_ecTadA-(SGGS)2-XTEN-(SGGS)2_nCas9_SGGS_NLS | (P48T_I49V_L84F_A106V_D108N_H123Y_A142N_D147Y_E155V_I156F_L157N) |
| pNMG-545 | pCMV_ecTadA-(SGGS)2-XTEN-(SGGS)2_nCas9_SGGS_NLS | P48S A142N |
| pNMG-546 | pCMV_ecTadA-(SGGS)2-XTEN-(SGGS)2_nCas9_SGGS_NLS | P48T_I49V_A142N |
| pNMG-547 | pCMV_ecTadA-(SGGS)2-XTEN-(SGGS)2-ecTadA-(SGGS)2-XTEN-(SGGS)2_nCas9_SGGS_NLS | (wt) + (P48S_L84F_A106V_D108N_H123Y_A142N_D147Y_E155V_I156F) |
| pNMG-548 | pCMV_ecTadA-(SGGS)2-XTEN-(SGGS)2-ecTadA-(SGGS)2-XTEN-(SGGS)2_nCas9_SGGS_NLS | (P48S_L84F_A106V_D108N_H123Y_A142N_D147Y_E155V_I156F) + (P48S_L84F_A106V_D108N_H123Y_A142N_D147Y_E155V_I156F)) |
| pNMG-549 | pCMV_ecTadA-(SGGS)2-XTEN-(SGGS)2-ecTadA-(SGGS)2-XTEN-(SGGS)2_nCas9_SGGS_NLS | (P48S_A142N) + (P48S_L84F_A106V_D108N_H123Y_A142N_D147Y_E155V_I156F)) |
| pNMG-550 | pCMV_ecTadA-(SGGS)2-XTEN-(SGGS)2-ecTadA-(SGGS)2-XTEN-(SGGS)2_nCas9_SGGS_NLS | (P48S_A142N) + (L84F_A106V_D108N_H123Y_D147Y_E155V_I156F) |
| pNMG-551 | pCMV_ecTadA-(SGGS)2-XTEN-(SGGS)2-ecTadA-(SGGS)2-XTEN-(SGGS)2_nCas9_SGGS_NLS | (wt) + (P48T_I49V_L84F_A106V_D108N_H123Y_A142N_D147Y_E155V_I156F_L157N) |
| pNMG-552 | pCMV_ecTadA-(SGGS)2-XTEN-(SGGS)2-ecTadA-(SGGS)2-XTEN-(SGGS)2_nCas9_SGGS_NLS | (P48T_I49V_L84F_A106V_D108N_H123Y_A142N_D147Y_E155V_I156F_L157N) + (P48T_I49V_L84F_A106V_D108N_H123Y_A142N_D147Y_E155V_I156F_L157N) |
| pNMG-553 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (P48T_I49V_L84F_A106V_D108N_H123Y_A142N_D147Y_E155V_I156F_L157N) |
| pNMG-554 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (L84F_A106V_D108N_H123Y_D147Y_E155V_I156F) |
| pNMG-555 | pCMV_ecTadA-24 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-556 | pCMV_ecTadA-24 a.a. linker-ecTadA-32 a.a. linker_nCas9_SGGS_NLS | (wt) + (H36L_R51L_L84F_A106V_D108N_H123Y_S146C_D147Y_E155V_I156F_K157N) |
| pNMG-557 | pCMV_ecTadA-24 a.a. linker-ecTadA-40 a.a. linker_nCas9_SGGS_NLS | (wt) + (H36L_R51L_L84F_A106V_D108N_H123Y_S146C_D147Y_E155V_I156F_K157N) |
| pNMG-558 | pCMV_ecTadA-32 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-559 | pCMV_ecTadA-32 a.a. linker-ecTadA-40 a.a. linker_nCas9_SGGS_NLS | (wt) + (H36L_R51L_L84F_A106V_D108N_H123Y_S146C_D147Y_E155V_I156F_K157N) |

TABLE 4-continued

Plasmid Identity Key

| Name | Construct Architecture | Mutations in TadA |
|---|---|---|
| pNMG-560 | pCMV_ecTadA-40 a.a. linker-ecTadA-24 a.a. linker_nCas9_SGGS_NLS | (wt) + (H36L_R51L_L84F_A106V_D108N_H123Y_S146C_D147Y_E155V_I156F_K157N) |
| pNMG-561 | pCMV_ecTadA-40 a.a. linker-ecTadA-32 a.a. linker_nCas9_SGGS_NLS | (wt) + (H36L_R51L_L84F_A106V_D108N_H123Y_S146C_D147Y_E155V_I156F_K157N) |
| pNMG-562 | pCMV_ecTadA-40 a.a. linker-ecTadA-40 a.a. linker_nCas9_SGGS_NLS | (wt) + (H36L_R51L_L84F_A106V_D108N_H123Y_S146C_D147Y_E155V_I156F_K157N) |
| pNMG-563 | pCMV_ecTadA-24 a.a. linker_nCas9_SGGS_NLS | wild-type |
| pNMG-564 | pCMV_ecTadA-24 a.a. linker_nCas9_SGGS_NLS | (H36L_R51L_L84F_A106V_D108N_H123Y_S146C_D147Y_E155V_I156F_K157N) |
| pNMG-565 | pCMV_ecTadA-(SGGS)2-XTEN-(SGGS)2-ecTadA-(SGGS)2-XTEN-(SGGS)2_nCas9_XTEN_MBD4_SGGS_NLS | (wt) + (H36L_R51L_L84F_A106V_D108N_H123Y_S146C_D147Y_E155V_I156F_K157N) |
| pNMG-566 | pCMV_ecTadA-(SGGS)2-XTEN-(SGGS)2-ecTadA-(SGGS)2-XTEN-(SGGS)2_nCas9_XTEN_TDG_SGGS_NLS | (wt) + (H36L_R51L_L84F_A106V_D108N_H123Y_S146C_D147Y_E155V_I156F_K157N) |
| pNMG-572 | pCMV_ecTadA-32 a.a.-_nCas9_SGGS_NLS | (H36L_P48S_R51L_L84F_A106V_D108N_H123Y_S146C_D147Y_E155V_I156F_K157N) |
| pNMG-573 | pCMV_ecTadA-32 a.a.-_nCas9_SGGS_NLS | (H36L_P48S_R51L_L84F_A106V_D108N_H123Y_S146C_A142N_D147Y_E155V_I156F_K157N) |
| pNMG-574 | pCMV_ecTadA-32 a.a.-_nCas9_SGGS_NLS | (H36L_P48T_I49V_R51L_L84F_A106V_D108N_H123Y_S146C_D147Y_E155V_I156F_K157N) |
| pNMG-575 | pCMV_ecTadA-32 a.a.-_nCas9_SGGS_NLS | (H36L_P48T_I49V_R51L_L84F_A106V_D108N_H123Y_A142N_S146C_D147Y_E155V_I156F_K157N) |
| pNMG-576 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_D147Y_E155V_I156F_K157N) |
| pNMG-577 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_A142N_D147Y_E155V_I156F_K157N) |
| pNMG-578 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_S146C_D147Y_E155V_I156F_K157N) |
| pNMG-579 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_A142N_S146C_D147Y_E155V_I156F_K157N) |
| pNMG-580 | pCMV_ecTadA-(SGGS)2-XTEN-(SGGS)2-ecTadA-(SGGS)2-XTEN-(SGGS)2_nCas9_SGGS_NLS | (H36L_P48S_R51L_L84F_A106V_D108N_H123Y_S146C_D147Y_E155V_I156F_K157N) + (H36L_P48S_R51L_L84F_A106V_D108N_H123Y_S146C_D147Y_E155V_I156F_K157N) |
| pNMG-581 | pCMV_ecTadA-32 a.a.-_nCas9_SGGS_NLS | (H36L_P48A_R51L_L84F_A106V_D108N_H123Y_S146C_D147Y_E155V_I156F_K157N) |
| pNMG-583 | pCMV_ecTadA-32 a.a.-_nCas9_SGGS_NLS | (H36L_P48A_R51L_L84F_A106V_D108N_H123Y_A142N_S146C_D147Y_E155V_I156F_K157N) |
| pNMG-586 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_E155V_I156F_K157N) |
| pNMG-588 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_A142N_D147Y_E155V_I156F_K157N) |
| pNMG-603 | pCMV_ecTadA-32 a.a.-_nCas9_SGGS_NLS | (W23L_H36L_P48A_R51L_L84F_A106V_D108N_H123Y_S146C_D147Y_E155V_I156F_K157N) |
| pNMG-604 | pCMV_ecTadA-32 a.a.-_nCas9_SGGS_NLS | (W23R_H36L_P48A_R51L_L84F_A106V_D108N_H123Y_S146C_D147Y_E155V_I156F_K157N) |
| pNMG-605 | pCMV_ecTadA-32 a.a.-_nCas9_SGGS_NLS | (W23L_H36L_P48A_R51L_L84F_A106V_D108N_H123Y_S146R_D147Y_E155V_I156F_K161T) |
| pNMG-606 | pCMV_ecTadA-32 a.a.-_nCas9_SGGS_NLS | (H36L_P48A_R51L_L84F_A106V_D108N_H123Y_S146C_D147Y_R152H_E155V_I156F_K157N) |
| pNMG-607 | pCMV_ecTadA-32 a.a.-_nCas9_SGGS_NLS | (H36L_P48A_R51L_L84F_A106V_D108N_H123Y_S146C_D147Y_R152P_E155V_I156F_K157N) |
| pNMG-608 | pCMV_ecTadA-32 a.a.-_nCas9_SGGS_NLS | (W23L_H36L_P48A_R51L_L84F_A106V_D108N_H123Y_S146C_D147Y_R152P_E155V_I156F_K157N) |
| pNMG-609 | pCMV_ecTadA-32 a.a.-_nCas9_SGGS_NLS | (W23L_H36L_P48A_R51L_L84F_A106V_D108N_H123Y_A142A_S146C_D147Y_E155V_I156F_K157N) |
| pNMG-610 | pCMV_ecTadA-32 a.a.-_nCas9_SGGS_NLS | (W23L_H36L_P48A_R51L_L84F_A106V_D108N_H123Y_A142A_S146C_D147Y_R152P_E155V_I156F_K157N) |

TABLE 4-continued

Plasmid Identity Key

| Name | Construct Architecture | Mutations in TadA |
|---|---|---|
| pNMG-611 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_E155V_I156F_K157N) |
| pNMG-612 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_E155V_I156F_K157N) |
| pNMG-613 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146R_D147Y_E155V_I156F_K161T) |
| pNMG-614 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152H_E155V_I156F_K157N) |
| pNMG-615 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152P_E155V_I156F_K157N) |
| pNMG-616 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_R152P_E155V_I156F_K157N) |
| pNMG-617 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_E155V_I156F_K157N) |
| pNMG-618 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_R152P_E155V_I156F_K157N) |
| pNMG-619 | pCMV_ecTadA-32 a.a.-_nCas9_SGGS_NLS | (W23R_H36L_P48A_R51L_L84F_A106V_D108N_H123Y_S146C_D147Y_R152P_E155V_I156F_K157N) |
| pNMG-620 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_R152P_E155V_I156F_K157N) |
| pNMG-621 | pCMV_ecTadA-32 a.a. linker-ecTadA-24 a.a. linker_nCas9_SGGS_NLS | (wt) + (H36L_P48A_R51L_L84F_A106V_D108N_H123Y_S146C_D147Y_R152P_E155V_I156F_K157N) |
| pNMG-622 | pCMV_ecTadA-32 a.a. linker-ecTadA-24 a.a. linker_nCas9_SGGS_NLS | (wt) + (H36L_P48A_R51L_L84F_A106V_D108N_H123Y_A142N_S146C_D147Y_R152P_E155V_I156F_K157N) |
| pNMG-623 | pCMV_ecTadA-32 a.a. linker-ecTadA-24 a.a. linker_nCas9_SGGS_NLS | (wt) + (W23L_H36L_P48A_R51L_L84F_A106V_D108N_H123Y_S146C_D147Y_R152P_E155V_I156F_K157N) |
| pNMG-624 | pCMV_ecTadA-32 a.a. linker-ecTadA-24 a.a. linker_nCas9_SGGS_NLS | (wt) + (W23R_H36L_P48A_R51L_L84F_A106V_D108N_H123Y_S146C_D147Y_R152P_E155V_I156F_K157N) |

Example 2

Evolution of Adenosine Base Editor Containing the D108N Mutation of ecTadA (Evolution #2)

An ecTadA construct with a D108N (pNMG-128) mutation was mutagenized via error-prone PCR, as in Evolution #1, and this library was selected against the same chloramphenicol site, except higher concentrations of chloramphenicol was used in the selection media to increase the stringency of the selection. This round of selection produced two new mutations which improved the editing efficiencies of ABE: D147Y and E155V.

In the first round of evolution, error-prone PCR was conducted on the ecTadA deaminase portion of a ecTadA-XTEN-dCas9 fusion construct followed by USER assembly to create a library of ecTadA-XTEN-dCas9 variants (varied only in the deaminase portion). These library members were transformed into S1030 cells containing a selection plasmid, which contained a single G to A point mutation in the active site portion of the chloramphenicol resistance gene. Cells were cultured overnight and plated on concentrations of chloramphenicol which were higher than the MIC of the S1030 cells with the selection plasmid. Surviving colonies were sub-cloned and re-challenged under the selection conditions and then sequenced to identify the genotype of the productive variants. Sanger sequencing analysis revealed that a D108N, a D108V, and a D108G mutation conferred the desired phenotype (A to G transition mutation in DNA). Subsequent studies involving individual clones isolated from this first round of evolution demonstrated that the D108N mutation was the optimal substitution at this site.

Figure 17:
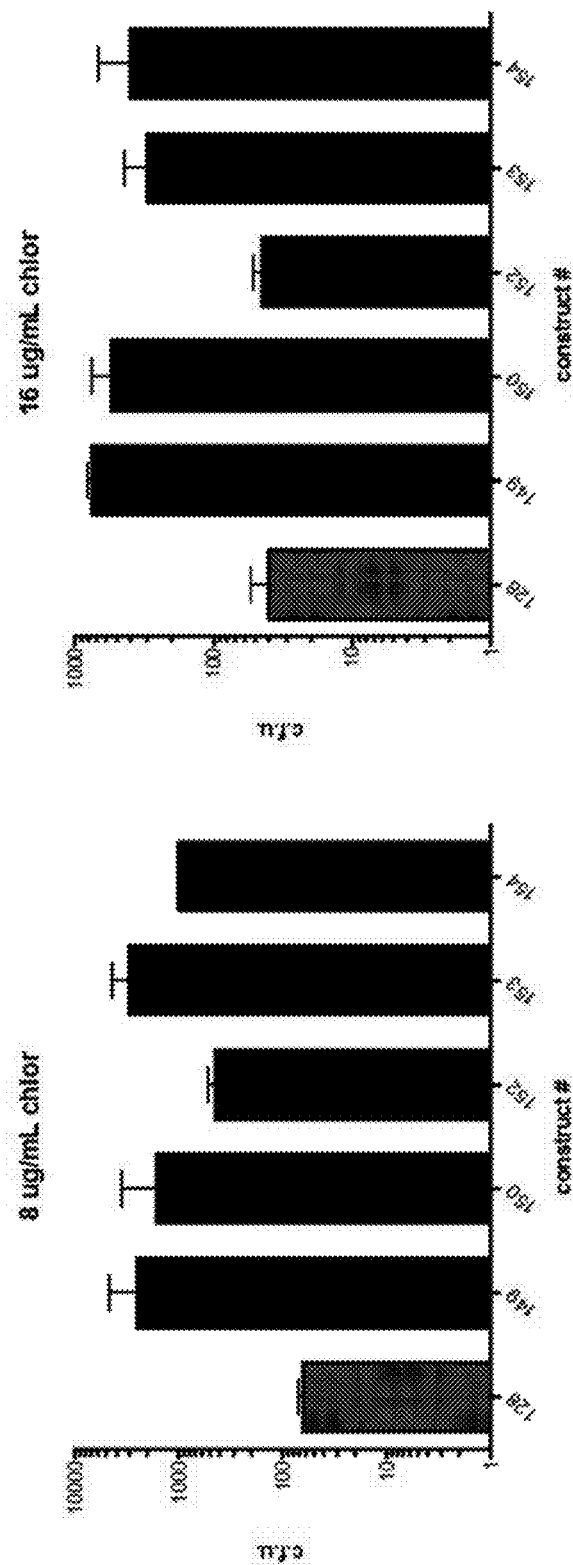
FIG. 17 shows the results of individual clone antibiotic challenge assays. The identity of the construct numbers correspond to the pNMG clone numbers from FIG. 16.
Figure 17:
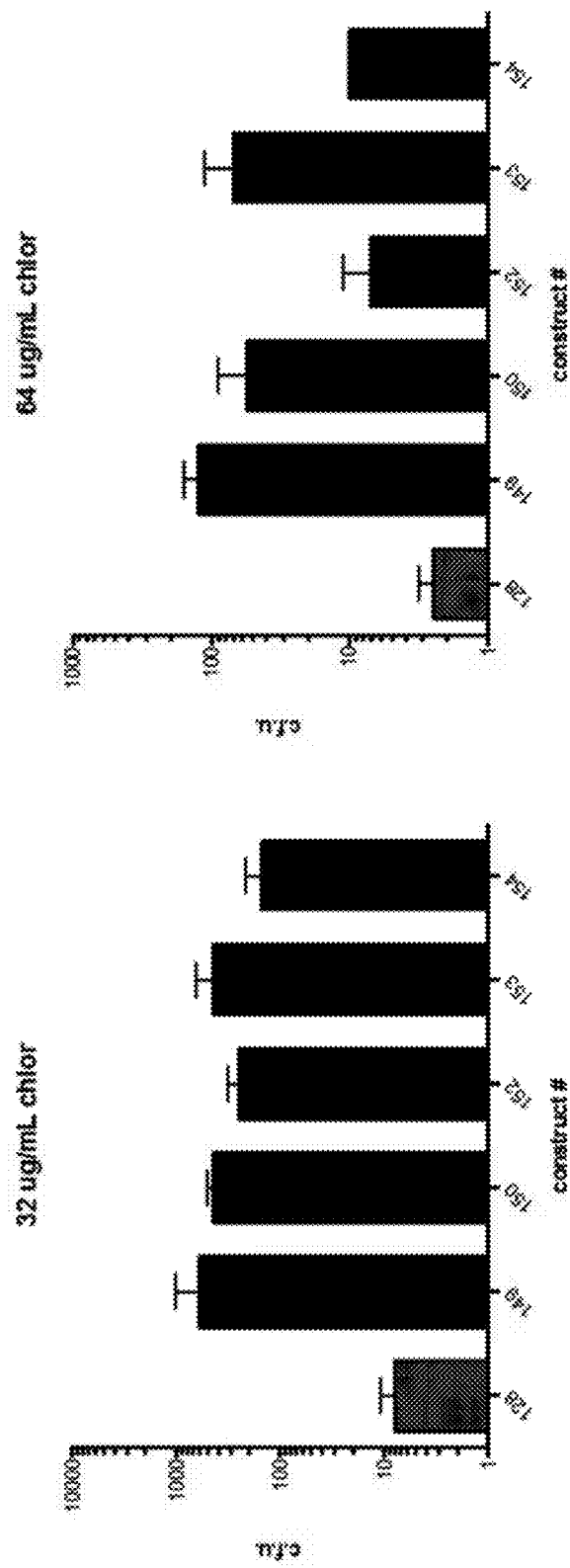
Figure 18:
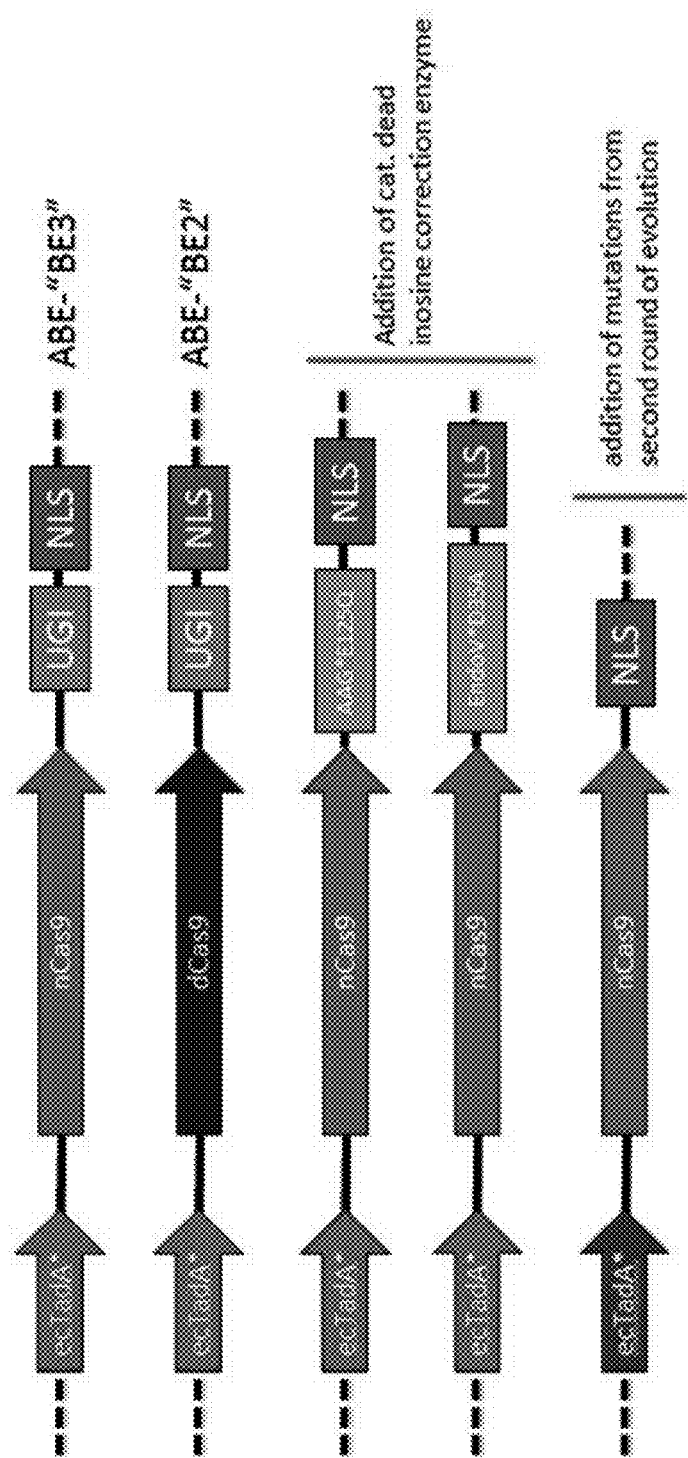
FIG. 18 show schematic representations of new constructs that were developed. New constructs include UGI, AAG*E125Q, and EndoV*D35A domains.

A second round of evolution was performed by evolving ecTadA containing a D108N mutation (see construct 3, clone 5, as listed in FIG. 11 (pNMG-128), which was identified from first round of evolution. pNMG-128 also contains mutations H8Y and N127S, which are "hitch-hiker" mutations. The evolved clones of the resulting library were challenged with 32, 64 and 128 ug/mL chloramphenicol (higher stringency than 1st round evolution of 1, 2 and 4 ug/mL). Clones which survived on 32, 64 and 128 ug/mL chloramphenicol were subcloned and re-plated, individual clones from this enrichment were isolated and assayed. The number of colony forming units (C.F.U) for each construct, pNMG-128 and pNMG 149-154, are shown in FIG. 17 under varying concentrations of chloramphenicol. A second round of evolution with high stringency conditions resulted in a high frequency of mutations at D147 and E155 of ecTadA, which are highlighted in FIG. 16.

Figure 23:
FIG. 23 shows inactive C-terminal Cas9 fusions of ecTadA for constructs pNMG-164 through pNMG-173. The sequence corresponds to SEQ ID NO: 41.
Figure 24:
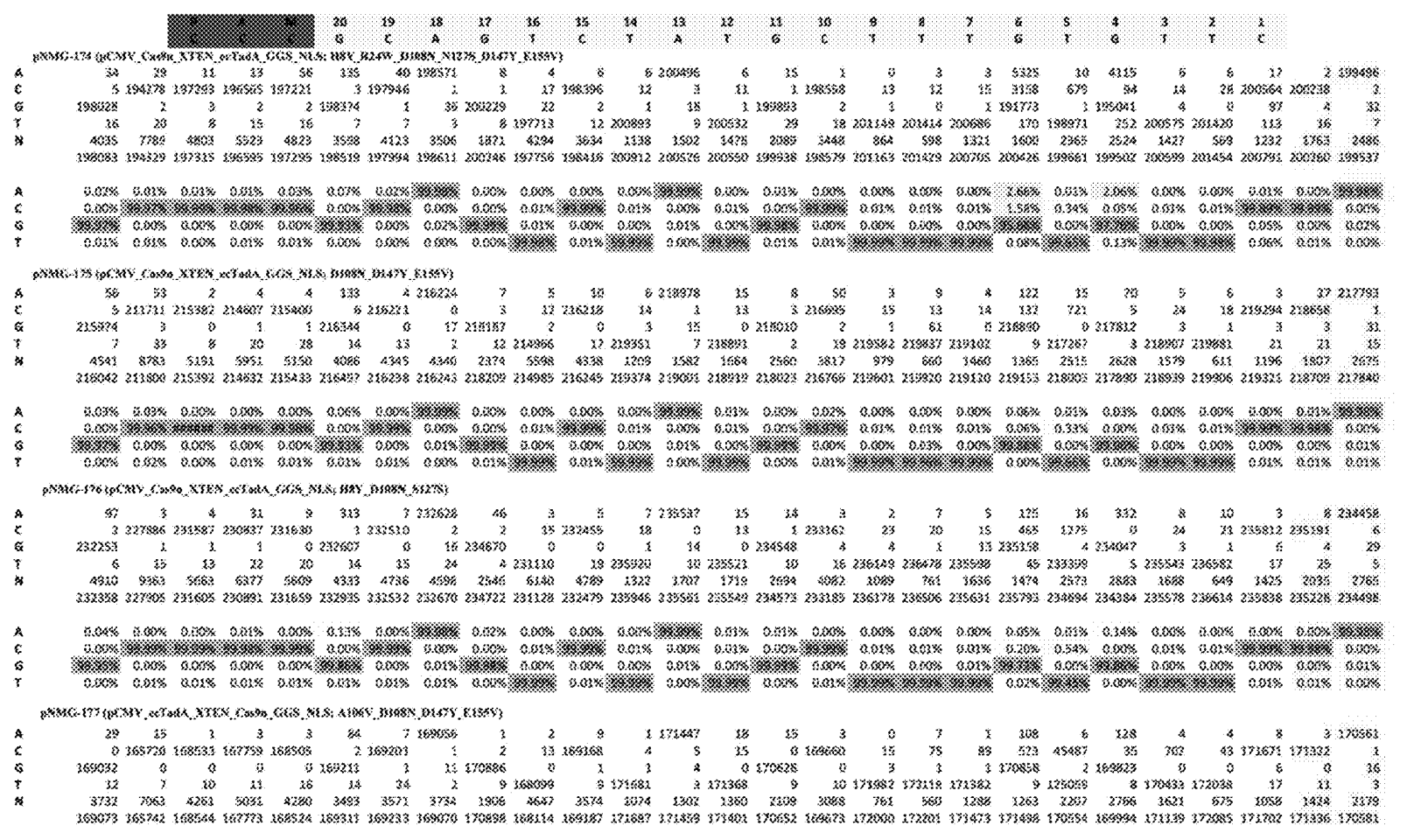
Figure 25:
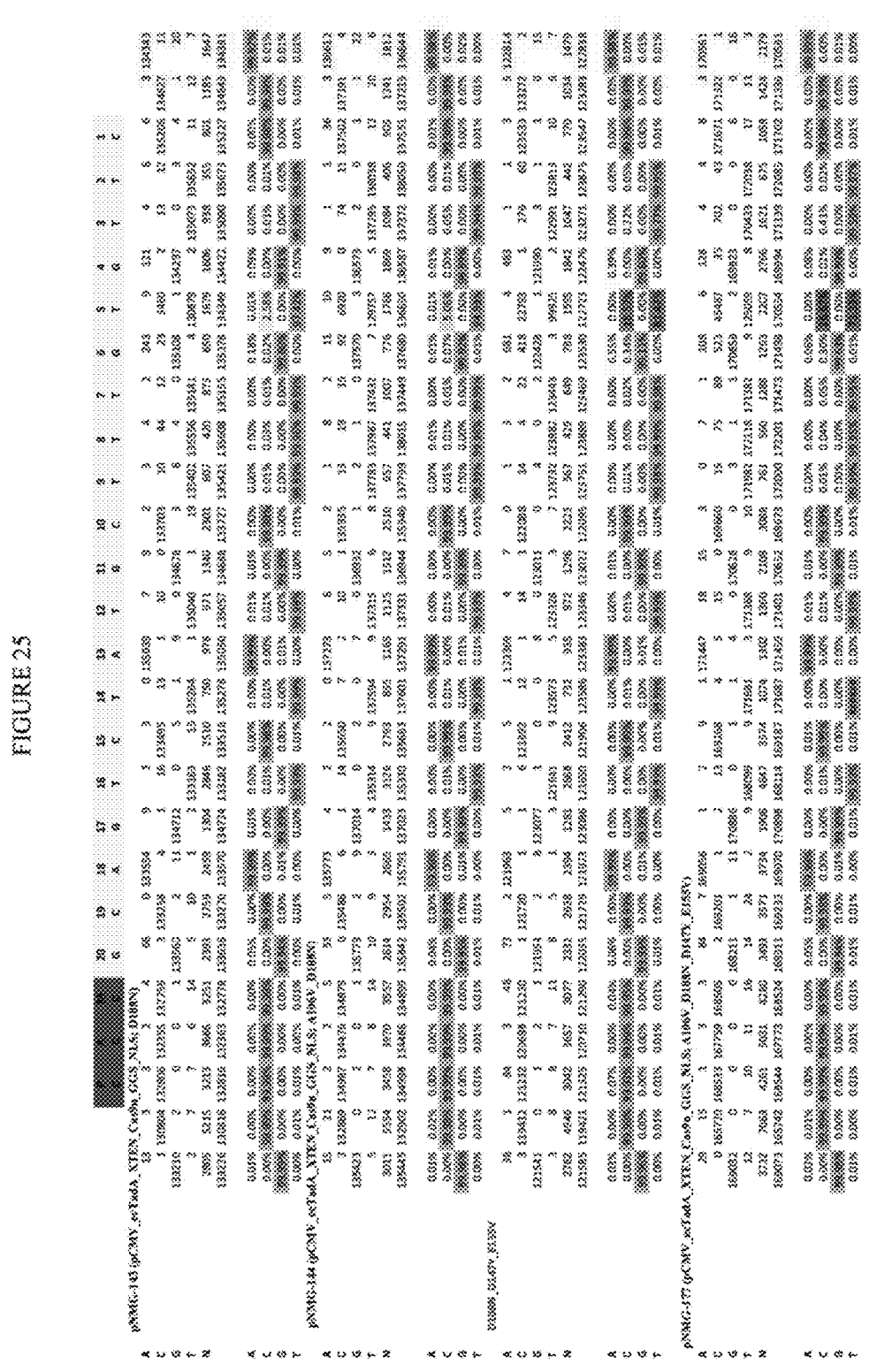
Figure 26:
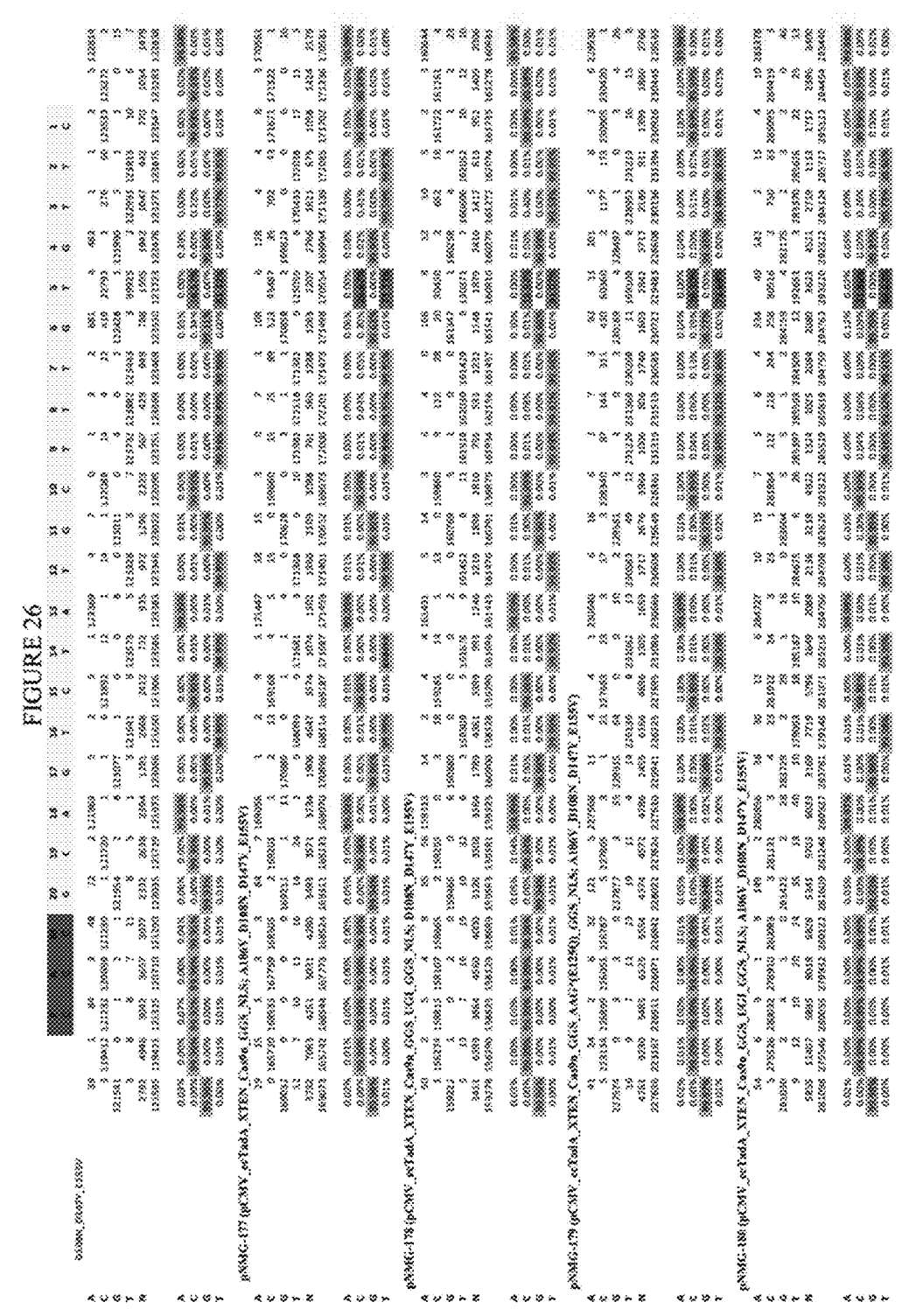
Figure 27:
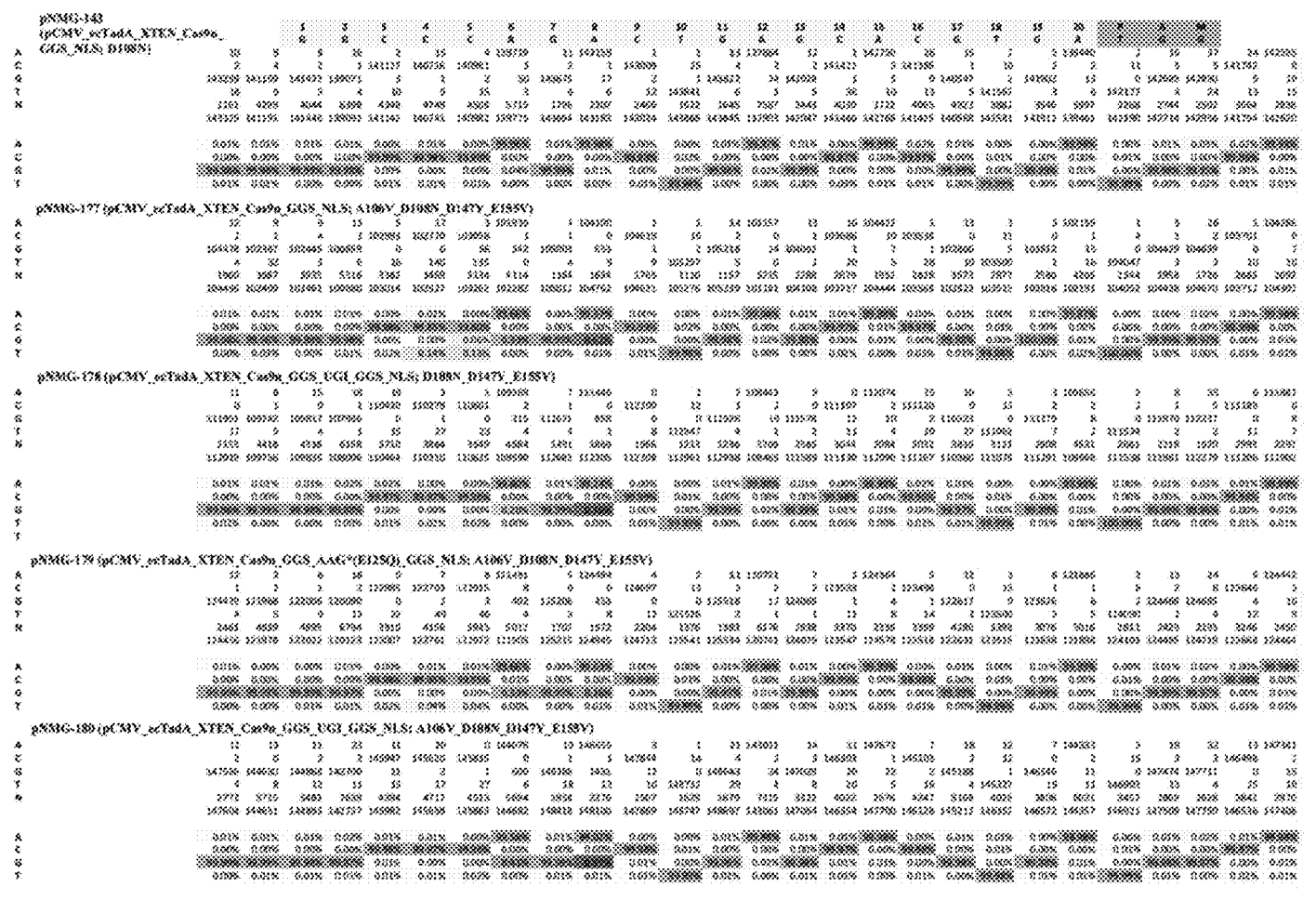

FIGS. 23-27 show the results of transfections of various ABE constusts into Hek293T cells, using a gRNA to direct the editor to the various genetic loci. FIG. 23 shows pNMG-164, 171, 172, and 173 editing on Hek-2. FIG. 24 pshows NMG-174-177 editing on Hek-2. FIG. 25 shows pNMG 143, 144, 164, 177 editing on Hek-2. FIG. 26 shows pNMG-164, pNMG-177, pNMG-178, pNMG-179, and pNMG-180 editing on Hek-2. FIG. 27 shows pNMG-164, 177-180 editing on Hek-2.

Regarding FIGS. 28-45, mammalian codon optimized constructs of ecTadA containing mutations at D108, (in some cases the mutations included the following: D108N, D108G, D108V) were used to probe whether D108 mutations identified in the first round of evolution also catalyzed A to G reversion in mammalian cells. Constructs pNMG-142-147 were transfected into Hek293T cells, and showed the greatest amount of A to G editing efficiencies at position #5 of the Hek-2 site, with low to no editing of adenines at any other sites. Exemplary DNA sequences that were targeted are described below as HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46). Subsequent experiments and evolutions have increased the editing efficiencies and identified that the editing window generally occurs at positions 4-6 in the protospacer and with a surrounding sequence of "YAC"; where "Y" is a pyrimidine (T or C) base and the underlined nucleotides, in the sequences below, is the PAM sequence. For the Hek2 sequence (SEQ ID NO: 41), shown below, the protospacer positions are indicated as 1-20 going from right to left. Position 5 of the protospacer at the Hek2 site is a T, which is opposite the A that may be edited by any of the adenosine deaminses described herein. For the Hek3, Hek4 RNF2, FANCF and EMX1 sequences (SEQ ID NOs: 42-46), shown below, the protospacer positions are indicated as 1-20 going from left to right. For these sequences one or more of the adenines (As), such as the A at position 6 of the Hek3 site (SEQ ID NO: 41), may be edited by any of the adenosine deaminses described herein. It should be noted that transfection of pNMG-142 (wild-type ecTadA fused to nCas9) produced no observable amounts of editing, underscoring the importance and necessity of implementation of the mutations arising from the directed evolution experiments. Target sequences used in the Examples are provided below (PAM sequences are underlined in bold):

```
Hek2:
CCCGCAGTCTATGCTTTGTGTTC          (SEQ ID NO: 41)

Hek3:
GGCCCAGACTGAGCACGTGATGG          (SEQ ID NO: 42)

Hek4:
GGCACTGCGGCTGGAGGTGGGGG          (SEQ ID NO: 43)

RNF2:
GTCATCTTAGTCAGGACCTGAGG          (SEQ ID NO: 44)

FANCF:
GGAATCCCTTCTGCAGCACCTGG          (SEQ ID NO: 45)

EMX1:
GAGTCCGAGCAGAAGAAGAAGGG          (SEQ ID NO: 46)
```

Engineering Adenosine Base Editors with Domains that Inhibit Reversion of Inosine to Adenine It was hypothesized that blocking inosine reversion to adenine, for example as a result of endogenous hAAG activity, could improve base editing efficiency. Accordingly, experiments were performed to examnine the effect of adding a catalytically inactive alkyl adenosine glycosylase to the C-terminal end of ABE editors. Base editor 3 (BE3) in these transfections served as the positive control for C to G base editing, pNMG-142 is the negative control, pNMG-143 is an evolution round #1 construct, pNMG-144 (D108N) is another evolution round #1 construct (A106V_D108N). The mutations in the pNMG-156 construct are all mutations identified from the highest frequency amplicons resulting from the first round of ecTadA bacterial evolution (including "hitch-hicker" mutations). Hitch-hiker mutations refer to mutations that were identified in evolution experiments, but may not have a significant effect on adenosine base editing. A method for identifying hitch-hiker mutations is to do reversion anaylsis and then re-assay the construct to determine whether the mutation has an effect on base editing. pNMG-156 is the mammalian codon-optimized version of pNMG-128 (the bacterial vector I isolated in the selection) with contains a C-terminal UGI. pNMG-160 is the equivalent of pNMG-143 having a catalytically inactive AAG (E125Q), pNMG-161 is pNMG-143 having a catalytically inactive Endo V (D35A). Mutations E125Q and D35A correspond to the mutations in the catalytically dead AAG and EndoV open reading frame (ORF), respectively. pNMG-162 thas the same construct architecture as pNMG-156, except it does not contain UGI. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 28-33, respectively. In general, it was found that, for the constructs tested, incorporation of UGI, AAG(E125Q), or EndoV (D35A)C-terminal to the ecTadA and the Cas9 domain did not provide a significant increase in the efficiency of the base editors to generate an adenosine to guanine mutation.

Arranging the Adenosine Deaminase Domain Relative to the Cas9 Domain

Arrangement of the adenosine deaminse domain (e.g., ecTadA) relative to the Cas9 domain in adenosine base editors was tested. For example, it was tested whether placement of the adenosine deaminase N-terminal or C-terminal relative to a Cas9 domain affected base editing efficiency. Further, experiments including mutations from evolution #1 of ecTadA and evolution #2 of ecTadA were compared. See FIGS. 34-39. In general, the mutations identified in evolution #2 improved the editing efficiencies of the ABE editors identified in evolution #1. Additionally, it was found that adenosine base editors were active (mutated adenine to guanine) when the adenosine deaminase was arranged N-terminal to Cas9. Adenosine base editor constructs where the adenosine deaminase was arranged C-terminal to Cas9 showed little to no observable editing of adenine to guanine.

The following ABE constructs were transfected into Hek293T cells; pNMG-142, which served as a negative control (no mutations in ecTadA); pNMG-143 (where ecTadA has a D108N mutation), pNMG-144 (where ecTadA has a A106V, and a D108N mutation) and pNMG-164 (where ecTadA has a D108N, a D147Y, and a E155V mutation). These constructs were mammalian codon optimized constructs with mutations from evolution #1. Construct pNMG-171 served as a control for the C-terminal TadA fusion constructs of pNMG-172 to pNMG-176, which contain various ecTadA mutations. pNMG-171 contains a C-terminal wild-type ecTadA fusion to nCas9, whereas pNMG-172-176 contain mutations in TadA idenitified from evolution #1. pNMG-177 and pNMG-178 represent two mammalian codon optimized plasmids with mutations identified from evolution #2, where pNMG-178 contains a UGI domain. pNMG-179 and pNMG-180 are the same as pNMG-177 but with an added C-terminal catalytically inactive AAG (E125Q), and a UGI domain, respectively. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 34-39, respectively.

In general, it was found that fusing the adenosine deaminase (ecTadA)N-terminal to the Cas9, as opposed to C-terminal, yielded more efficient base editing of adenine. It was also found that ecTadA containing the mutations A106V, D108N, D147Y, and E155V performed better (e.g., edited adenine more efficiently) than the other ecTadA mutations tested in evolution #1 and evolution #2. Further, it was found that for the constructs tested, incorporation of UGI, or AAG(E125Q), in these constructs did not provide a significant increase in the efficiency of the base editors to generate an adenosine to guanine mutation.

Figure 40:
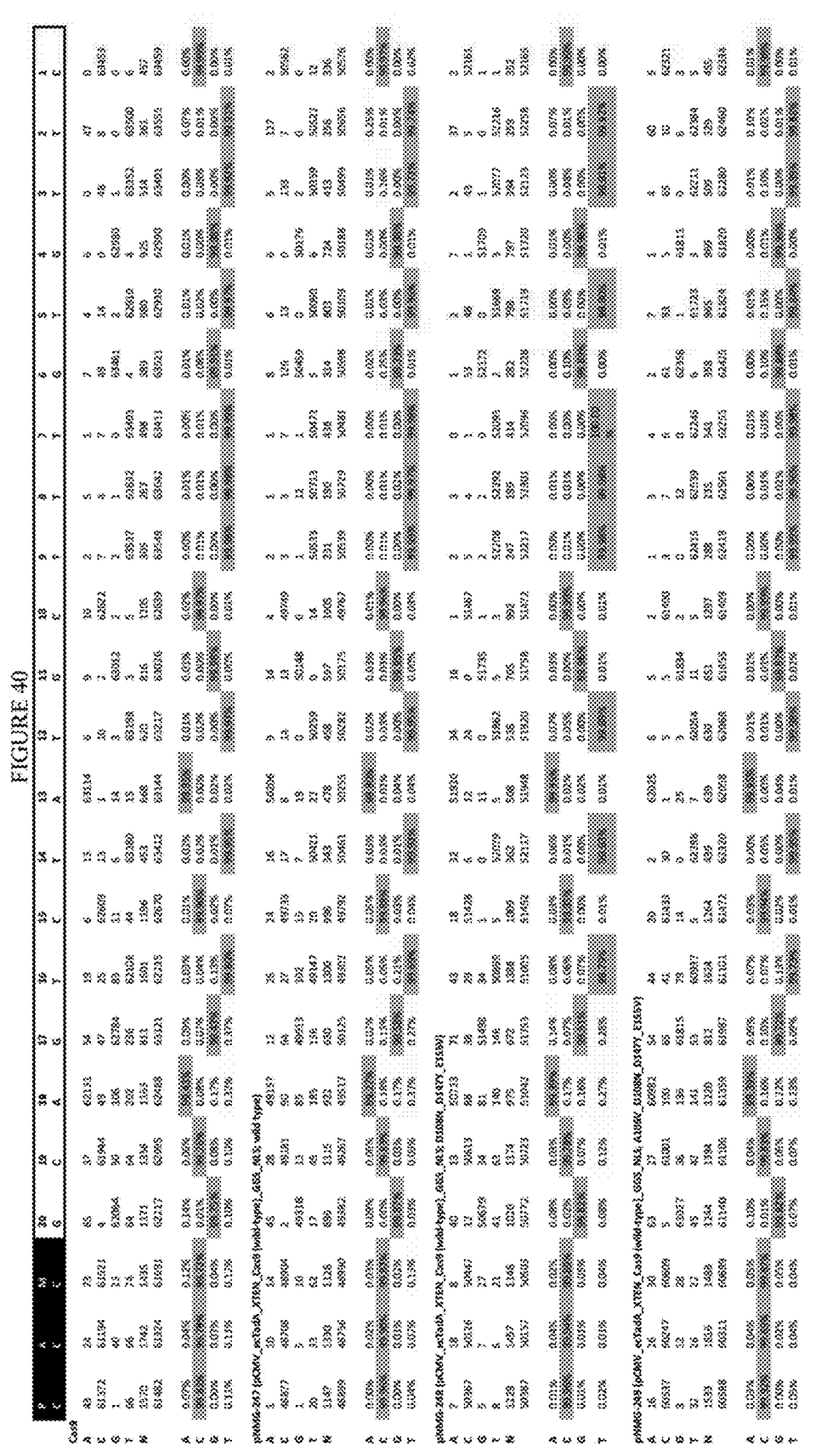
Figure 40:
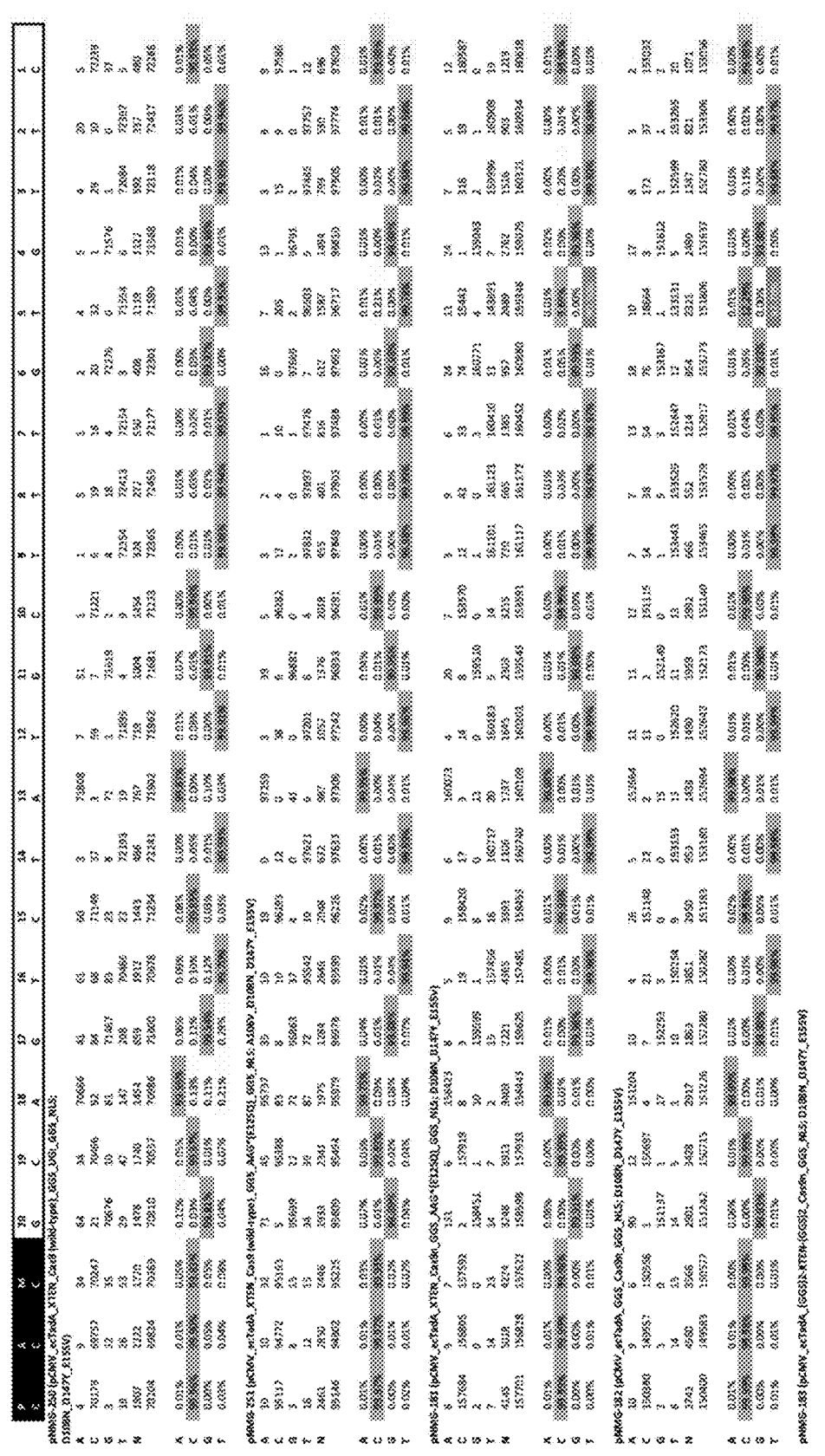
Figure 40:
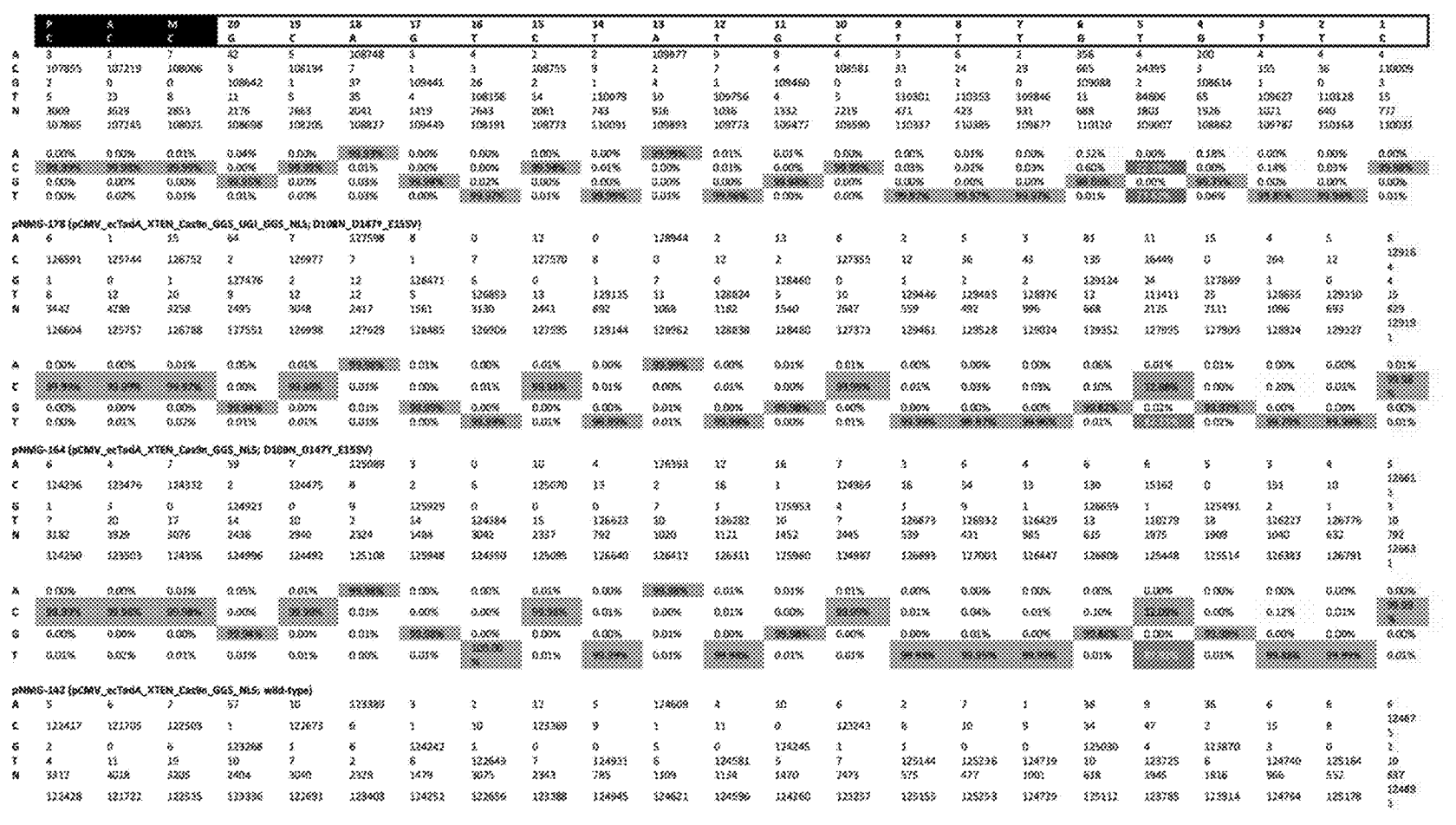
Figure 40:
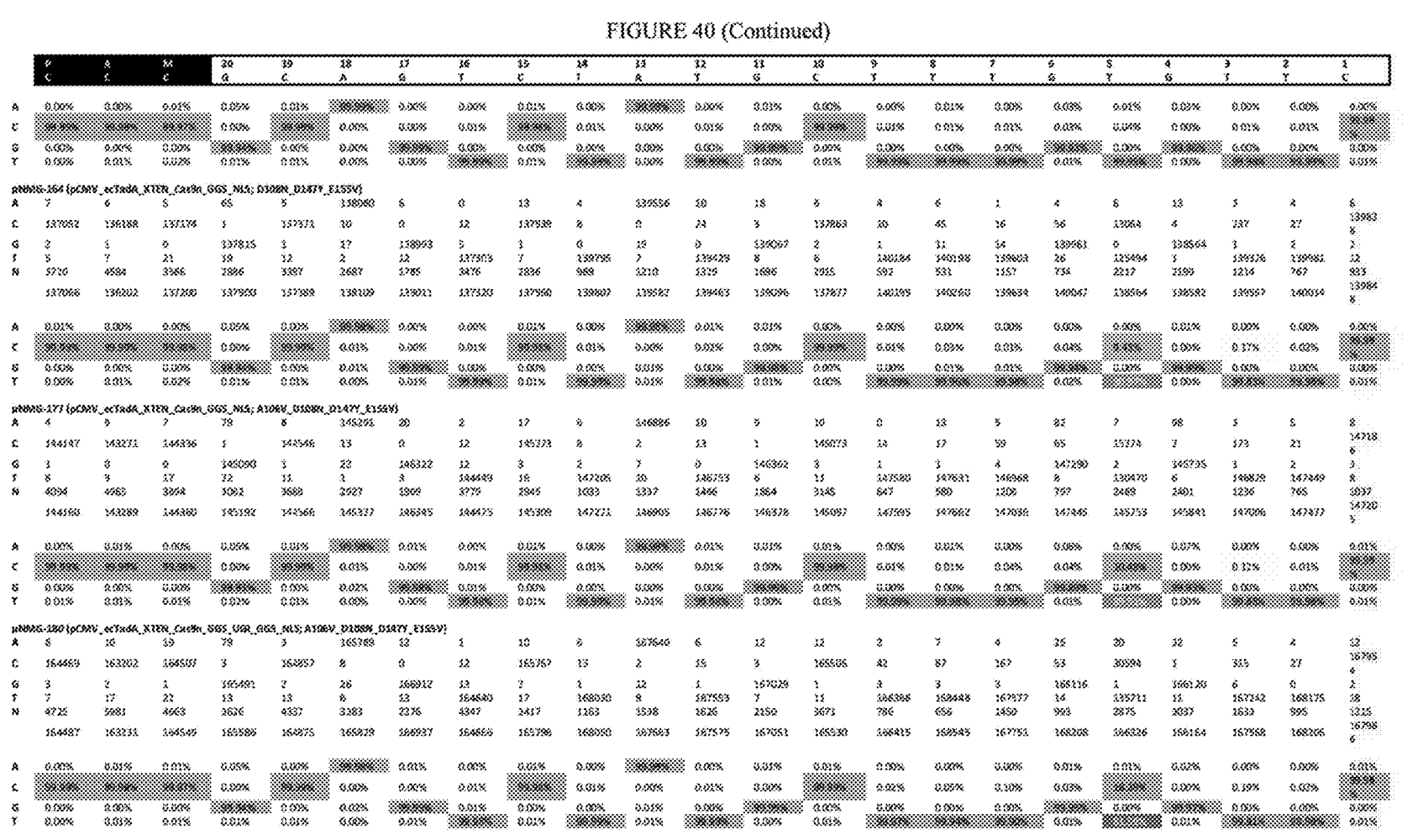
Figure 40:
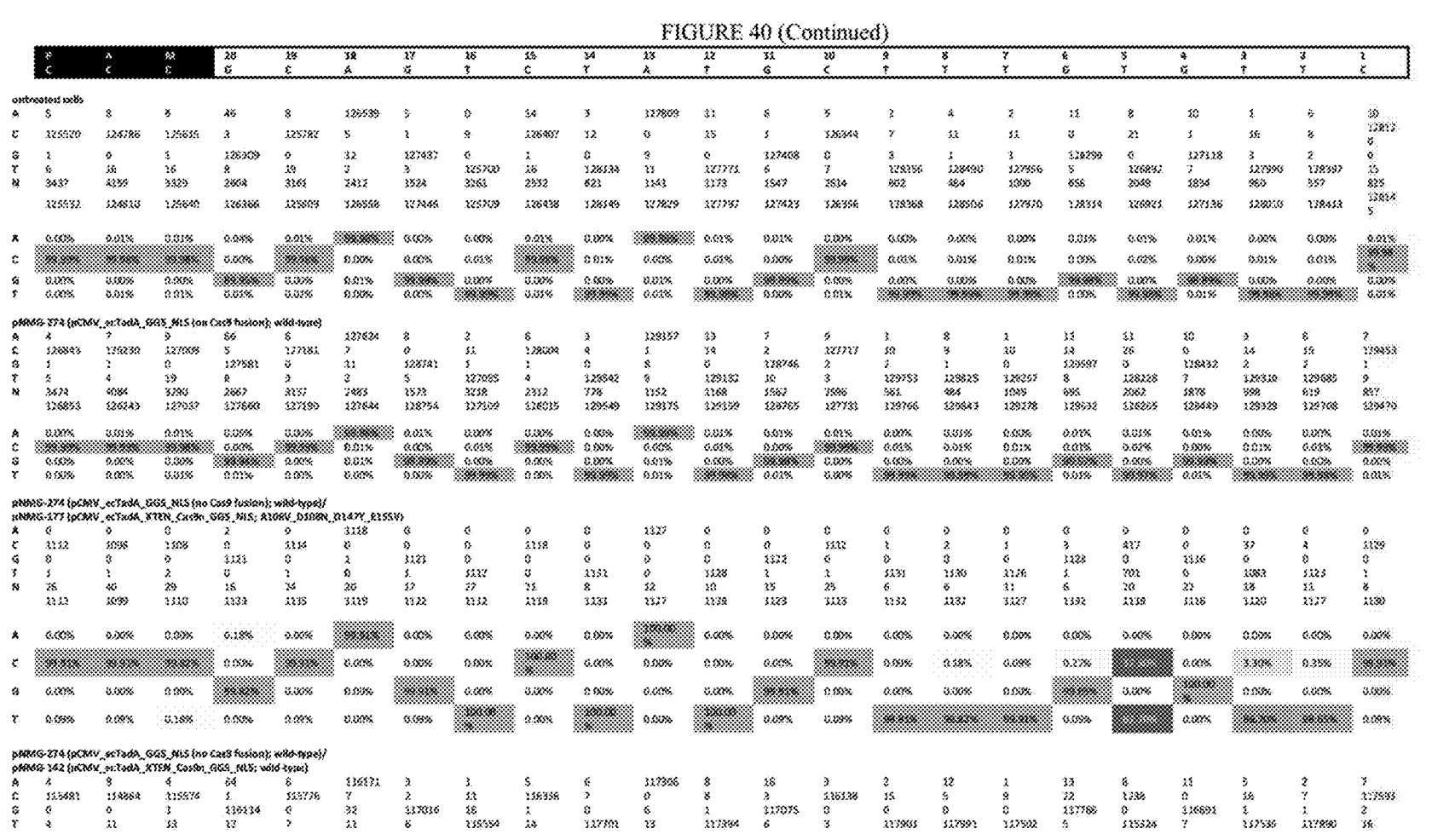
Figure 40:
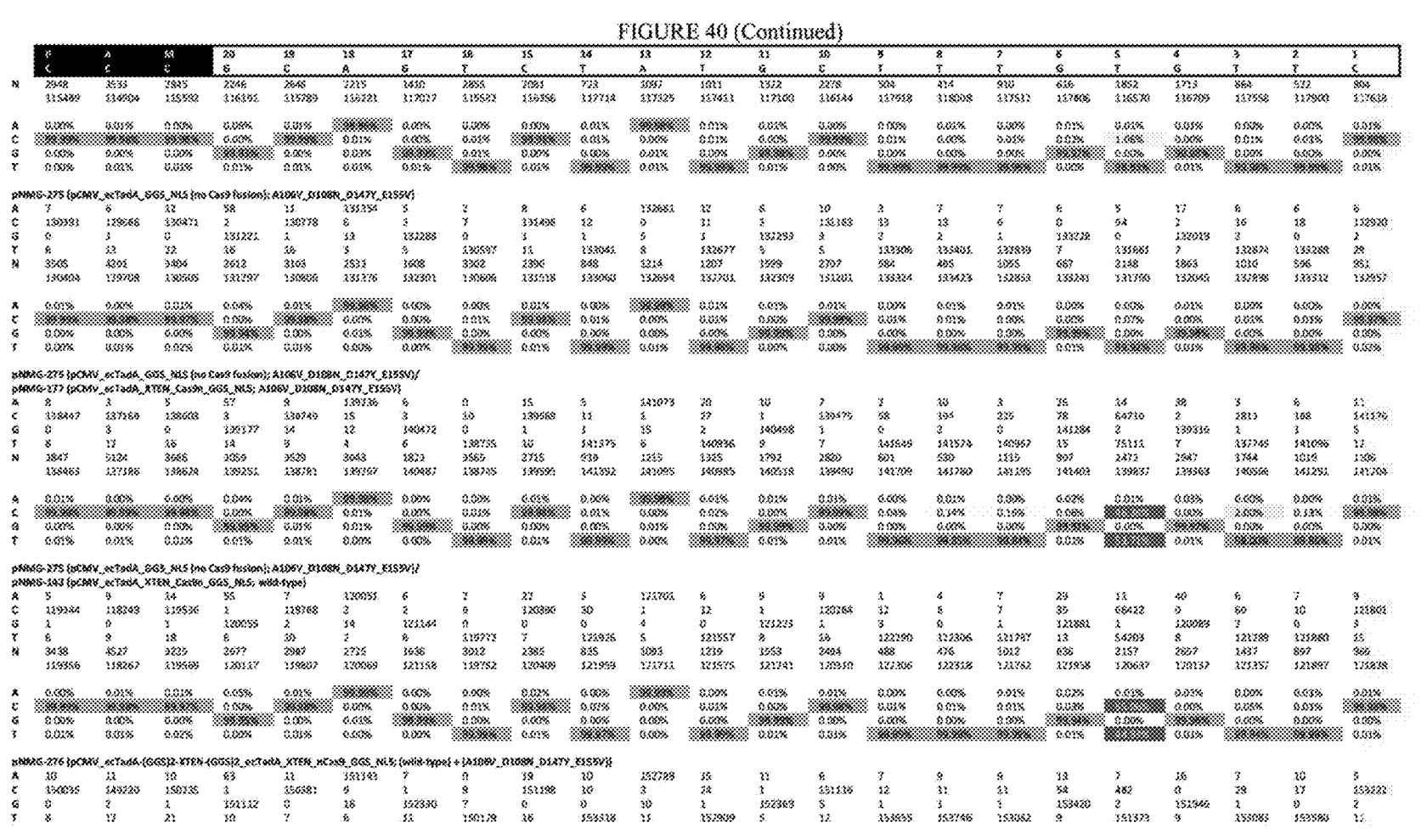
Figure 40:
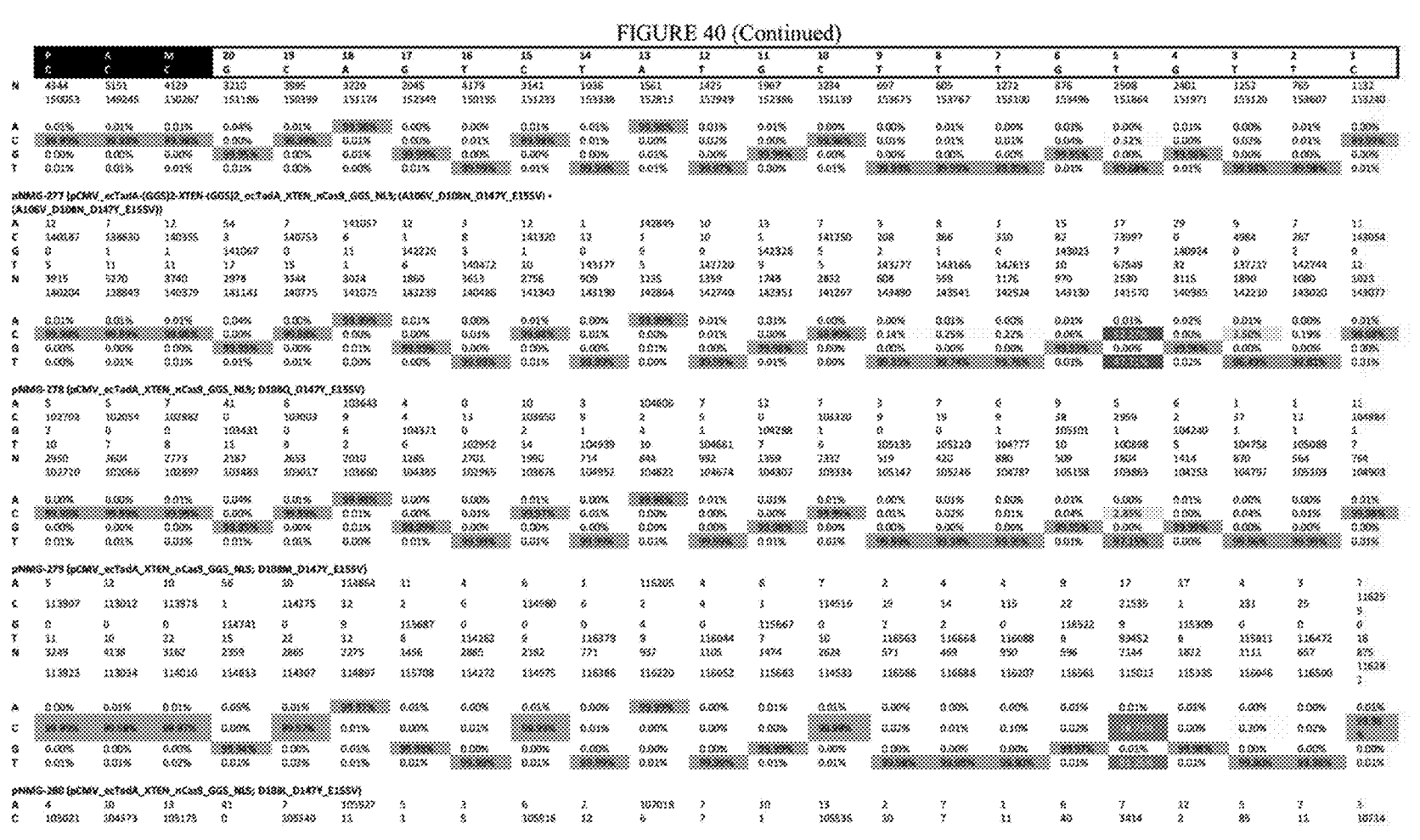
Figure 40:
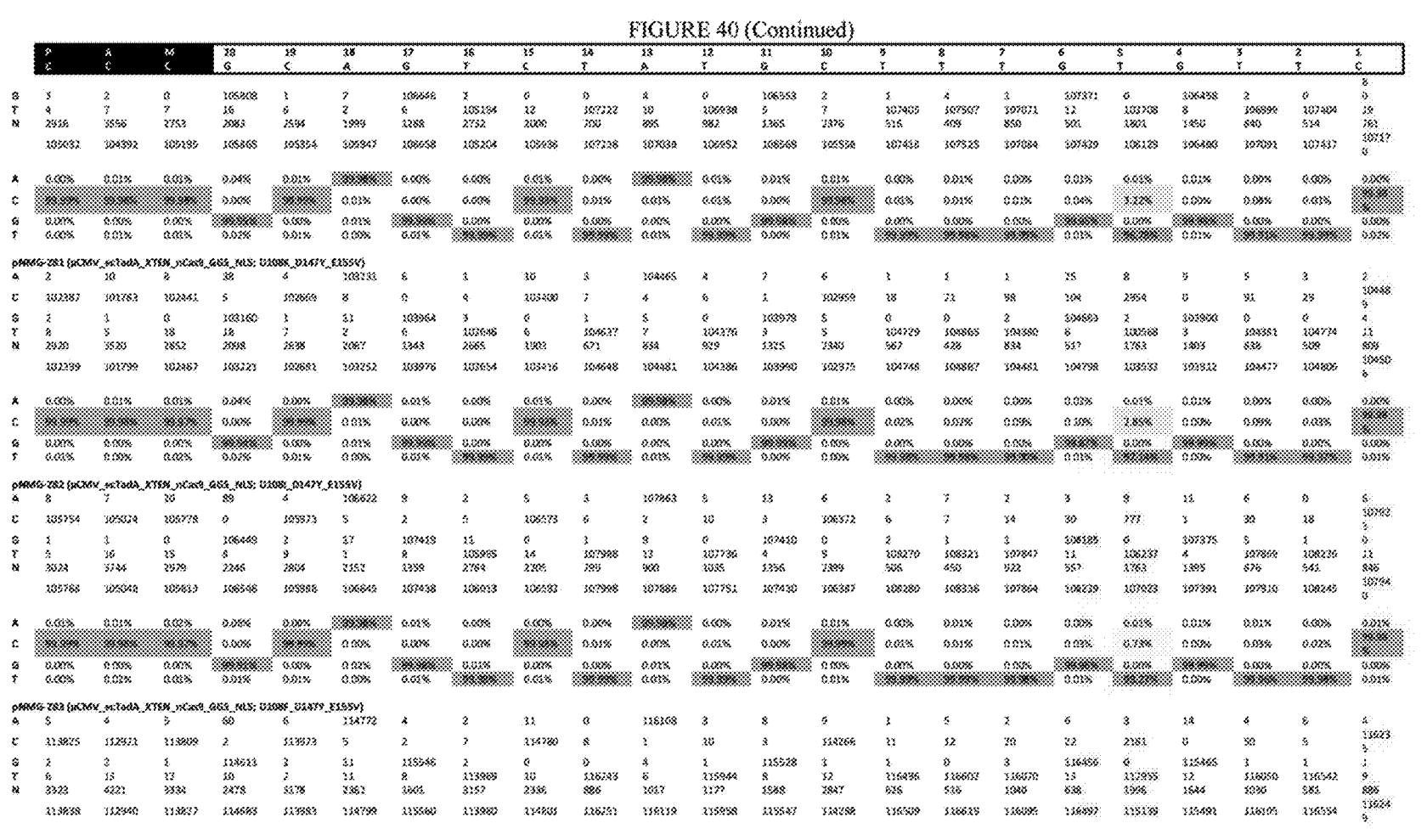
Figure 40:
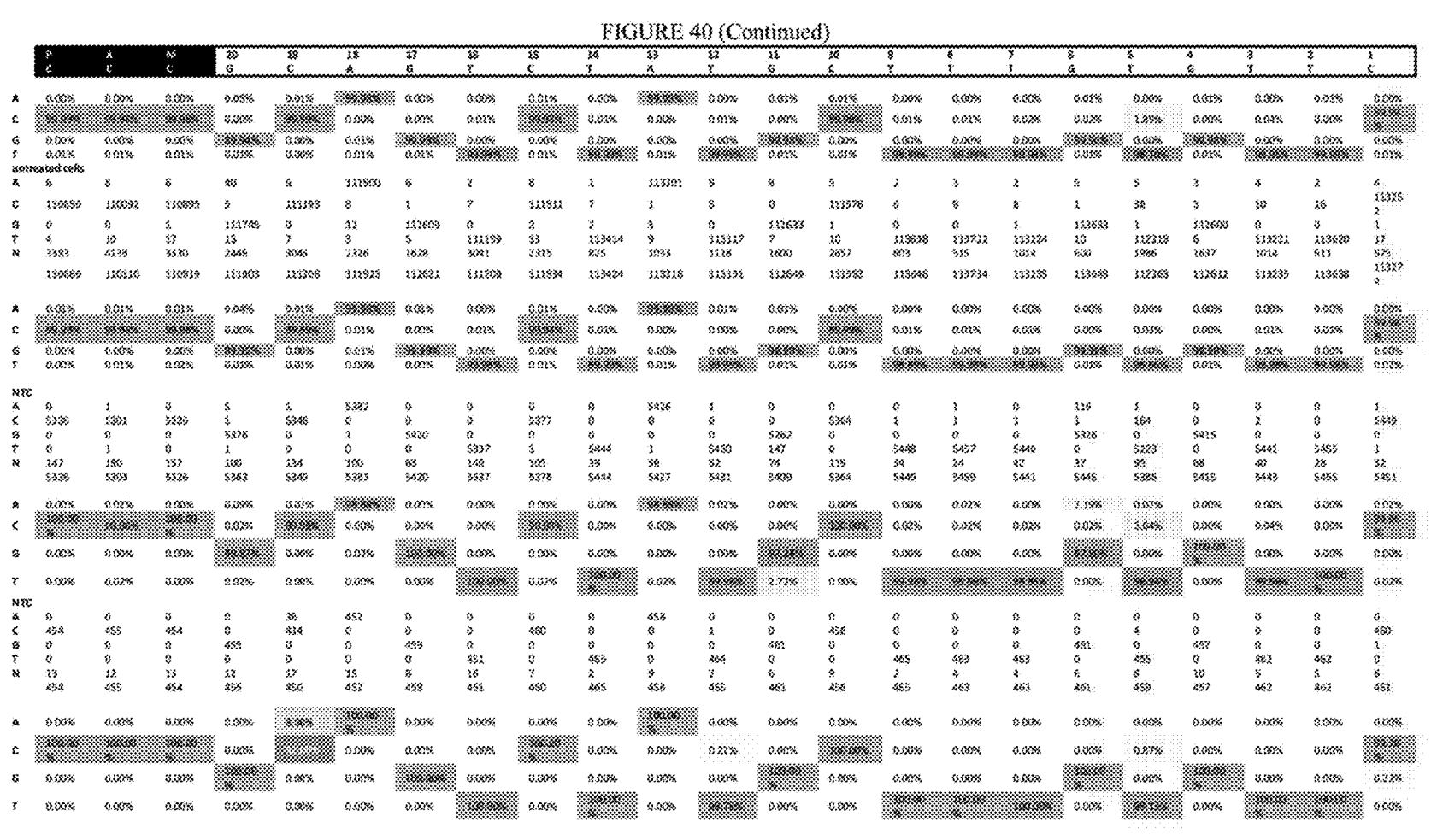

The transfection experiments shown in FIG. 40 were performed to determine four key points: One, whether ecTadA interferes with gRNA/Cas9 binding by deaminating As in the RNA of the guide. Two, whether a short linker (GGS only) or a long linker ((SGGS)$_2$-XTEN-(SGGS)$_2$) ((SGGS)$_2$) corresponds to SEQ ID NO: 2) between the evolved deaminase and Cas9 affects window size and/or overall editing efficiencies of ABE. Three, whether or not dimerization of evolved ecTadA improves ABE editing efficiencies. Four, if other substitutions at the position D108 in TadA could further enhance editing efficiencies. It was found that the ABE editors do not interfere with gRNA/Cas9 binding and that dimerization of ecTadA does improve editing efficiencies. To test whether ABE interfers with gRNA/Cas9 binding nCas9 was replaced with wild-type Cas9 in various evolved ABE constructs (pNMG-247-251) and compared INDEL rates to Cas9 (wt) only INDEL rates (see FIG. 48). A to G editing efficiencies are undetectable in FIG. 40 for pNMG-247-251, likely due to wild-type Cas9 nuclease activity. It was also determined that the long linker between the evolved ecTadA and nCas9 (pNMG-183) yielded higher editing efficiencies relative to XTEN only and GGS only linkers. Most strikingly, dimerization of the ecTadA unit of ABE was tested both in trans by co-transfecting equimolar amounts of ecTadA (with and without mutations from evolution) with ABE editors pNMG-142 (neg control), pNMG-177 (A106V_D108N_D147Y_E155V) and in cis by making editiors in which two untis of ecTadA were covalently tethered (with a (SGGS)$_2$-XTEN-(SGGS)$_2$ linker). Monomeric units used for in trans dimerization expeiments are pNMG-274 and pNMG-275. Covalent fusions of two untis of ecTadA in the ABE editor are represented in pNMG-276 (negative control, two units of wild-type TadA in the ABE editor) and pNMG-277. Lastly, transfections with plasmids pNMG-278-283, which represent ABE editors that have varying mutations at D108 position in ecTadA (e.g. D108M, D108Q, D108K, etc), showed that the D108N substitution originally identified in round #1 evolution is the best performing mutation at this position.

Example 3

Development of Adenosine Base Editors (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resitance gene which require two A to G reversions (both in premature stop codons) to conder kanamycin resistance. The 2 gRNA/2 target approach was used to increase the stringency of the selection. This evolution resulted in the identification of the following new mutations: L84F, H123Y and I157F.

Deaminase Editing sgRNA

During the development of ABE, it was questioned whether or not the deaminase was editing the sgRNA and did TadA still have RNA activity. Based on the results shown in FIG. 48, fusions appeared to bind well, but there was no significant difference between ABE and Cas9 indel percentage. This demonstrates that ABE is not interfering or modifiying the gRNA strand. Differences between wt Cas9 only and ABE fused to wild-type Cas9 would suggest deaminase interference with the gRNA. This was not the case.

Figure 51:
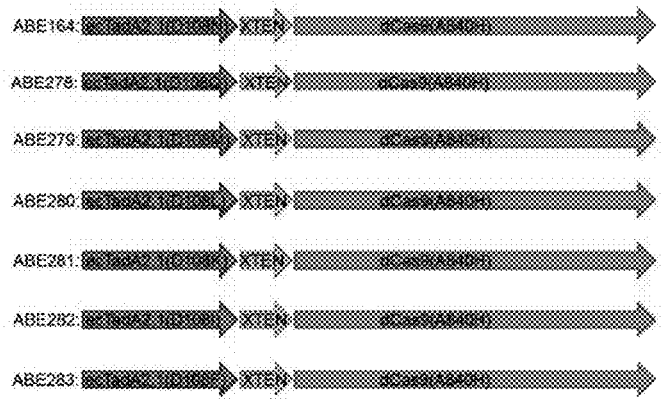
FIG. 51 shows the protospacer and PAM sequences of base editing sites set forth in SEQ ID NOs: 6, 46, and 42 from top to bottom, respectively.
Figures 53, 54, 55:
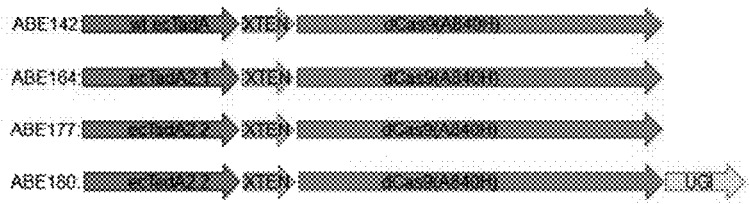
FIG. 53 shows the results of using mutated D108 residues to cause deaminase to reject RNA as a substrate and change the editing outcome.
FIG. 54 shows constructs developed for fusions at various sites.
FIG. 55 shows the protospacer and PAM sequences of base editing sites set forth in SEQ ID NOs: 6, 358, 359 from top to bottom, respectively.

It was also questioned whether or not D108 residue could be further mutated to cause deaminase to reject RNA as a substrate. The sgRNAs encoding sites can be found in FIG. 51. Results have shown that a D108M mutation in ecTadA does not significantly improve editing efficiency of the adenosine base editors.

It was found that tethering an additional unit of the mutant TadA to the ABE results in higher editing efficiencies for deamination of the DNA. Tethering an AAG, a base excision repair enzyme, to ABE did not significantly enhance base editing. Tethering catalytically inactivated EndoV, the *E. Coli* DNA repair enzyme, to ABE also did not significantly enhance base editing. Furthermore, knock-out cell lines of AAG (which revert inosine back to A) had no better editing efficiencies than the parent strain.

Figures 56, 57, 58:
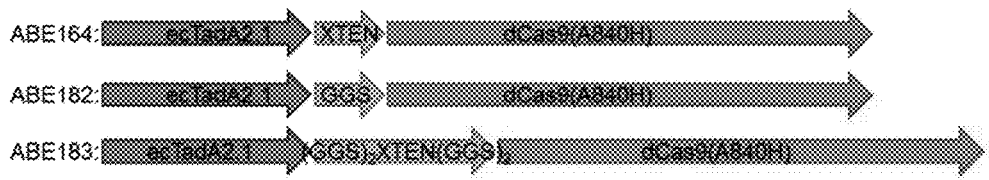
FIG. 56 shows the results of ABE on HEK site 2.
FIG. 57 shows the results of ABE on HEK site 2.
FIG. 58 shows constructs developed for fusions at various sites using various linker lengths.
Figure 61:
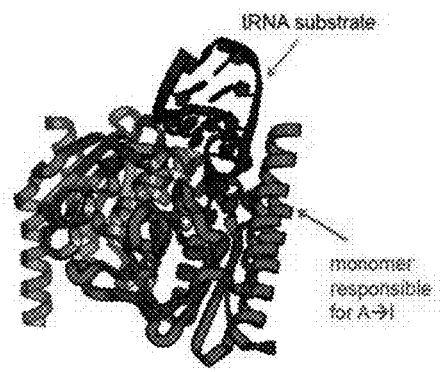
FIG. 61 is a schematic showing the dimerization of deaminase.
Figure 62:
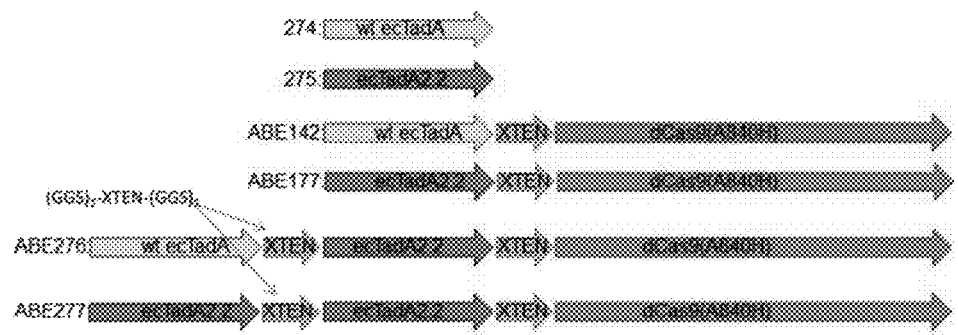
FIG. 62 shows constructs developed for fusions at various sites using various linker lengths.

A next goal was to determine why ABE edit more efficiently on the HEK site 2 than on other sites tested. While adenosine base editors worked well at all sites, they worked optimally at the Hek-2 site. It was theorized that ABE worked best on HEK site 2 due to an abundance of adenine residues. Results shown in FIG. 57 show that this is not the case. Another theory was that linker length could be why ABE only worked on the HEK site 2. Results shown in FIG. 59 and FIG. 60 proved inconclusive. The longest linker to Cas9 between ecTadA and Cas9 enhanced editing efficiencies but did not seem to expand the base editing window. It was also tested whether an ABE efficiently edited Hek-2 similar sites and it was found that there was very efficient editing at Hek-2 similar sites. From this data it was found that the ABEs edited adenines more efficiently when they were part of a "YAC" consensus sequence, where Y is C or T. Also, the tRNA substrate of ecTadA is in the context of "U-A-C" which is YAC.

Figure 63:
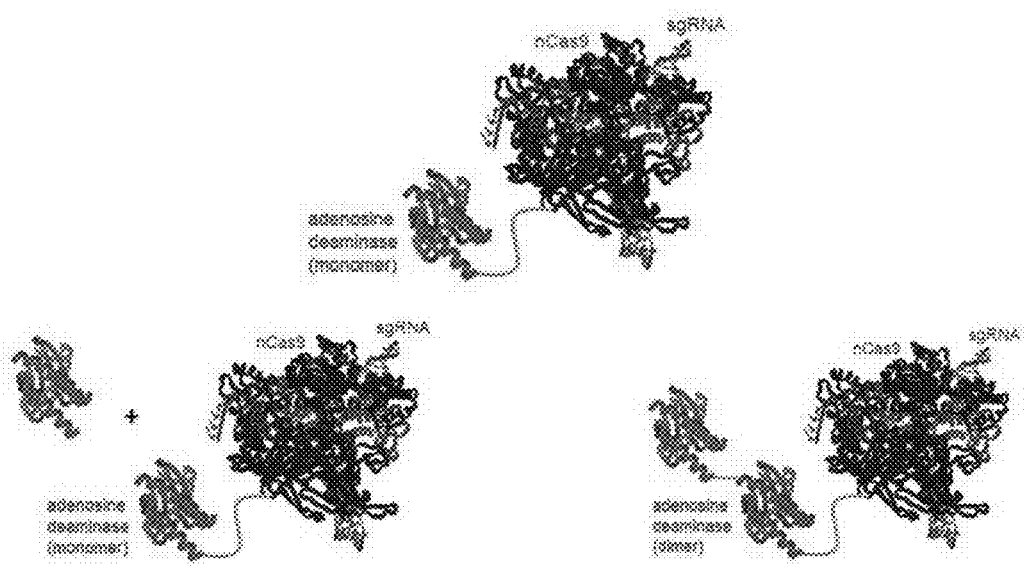
FIG. 63 shows the current editor architecture (top panel), the in trans dimerization (bottom panel, left), and the in cis dimerization (bottom panel, right).
Figures 64, 65:
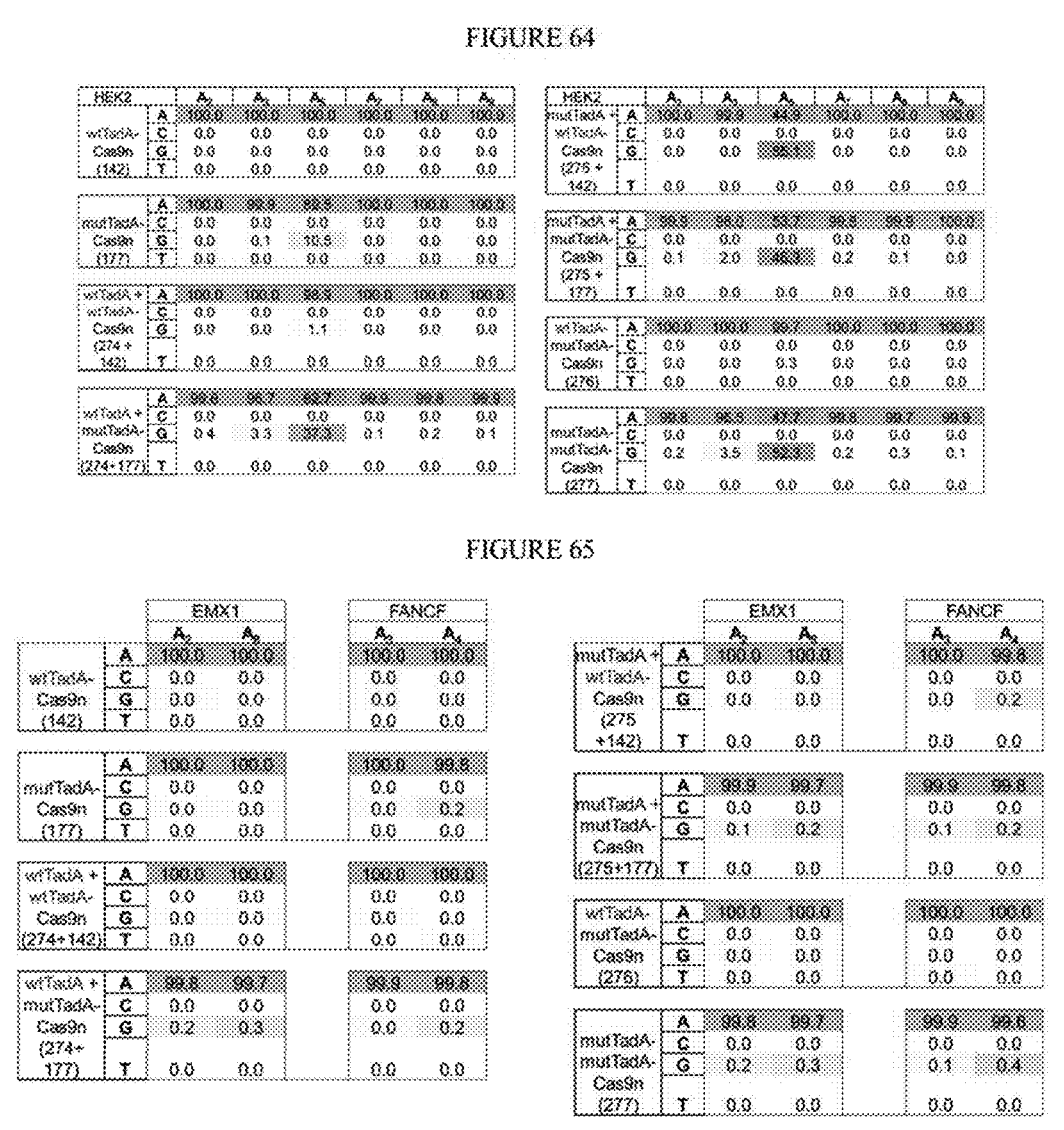
Figures 66, 67:
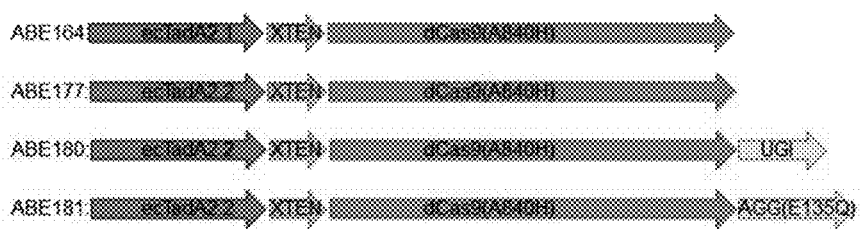
FIG. 66 shows dimerization results from base editing.
FIG. 67 shows constructs developed for fusions at various sgRNA sites.
Figure 68:
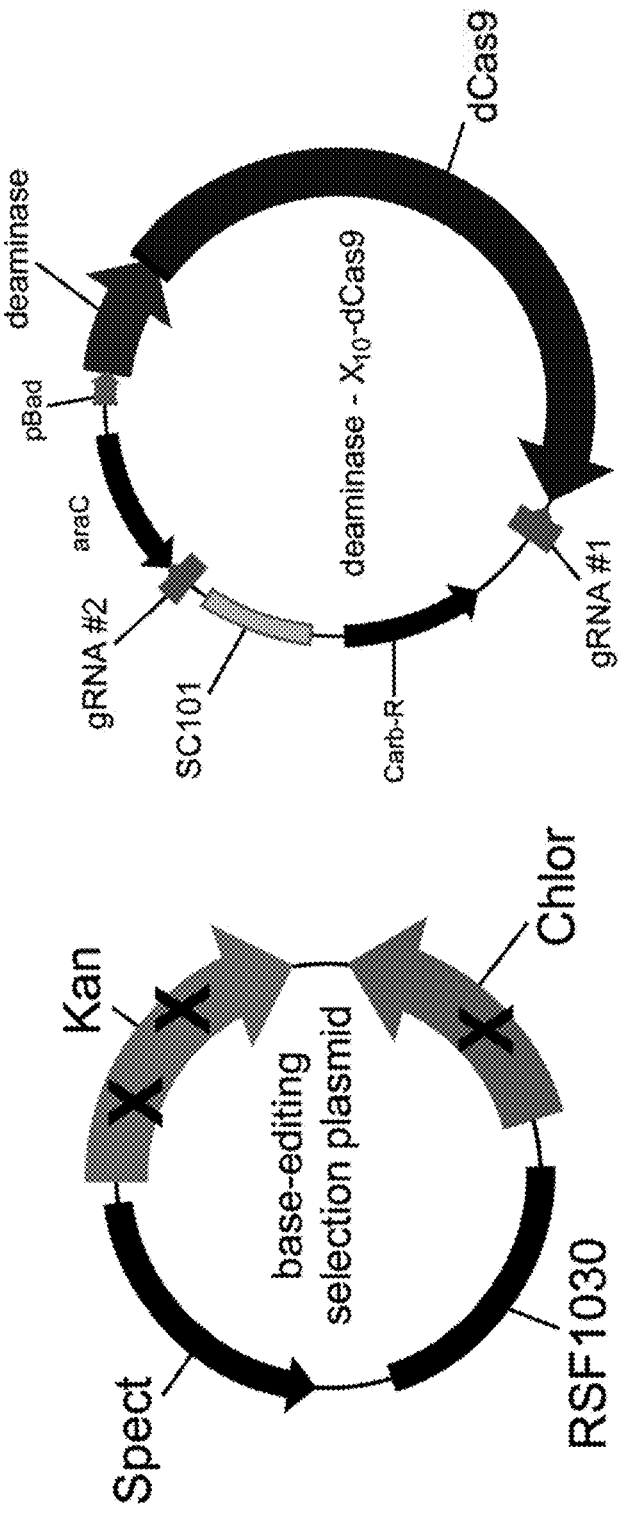
FIG. 68 shows the evolution of ABE editor against new selection sequences. The sequences from top to bottom and left to right correspond to SEQ ID NOs: 707-719, respectively.

It has been suggested that dimerization of the deaminase may improve base editing. The current editor architecture, in trans dimerization, and in cis dimerization are shown in FIG. 63 (top structure, bottom left structure, and bottom right structure). Results shown in FIG. 64 through FIG. 66 show that dimerization of the deaminase improved base editing. With respect to the "YAC" sequence specificity, one hypothesis, supported by the data, is that ABE operates best on As in positions 4-6 of the protospacer and with a surrounding sequence of "YAC"; target A underlined, where Y is C or T.

Evolving ABE Editor Against New Selection Sequences

Figure 69:
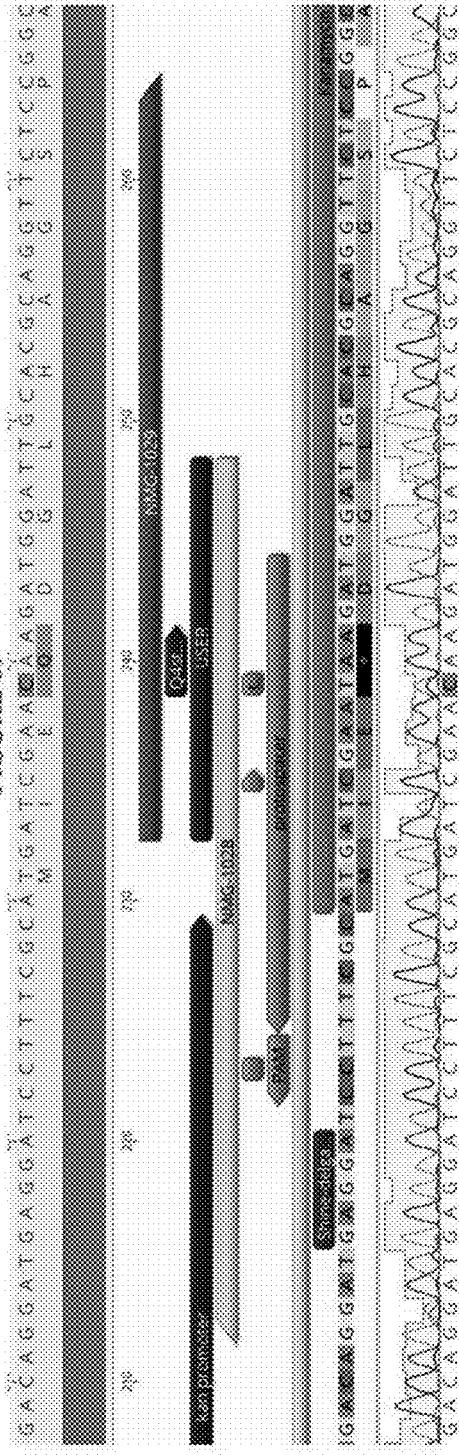
FIG. 69 shows the current editor targeting Q4 stop site. The sequences from top to bottom correspond to SEQ ID NOs: 624-628.
Figure 70:
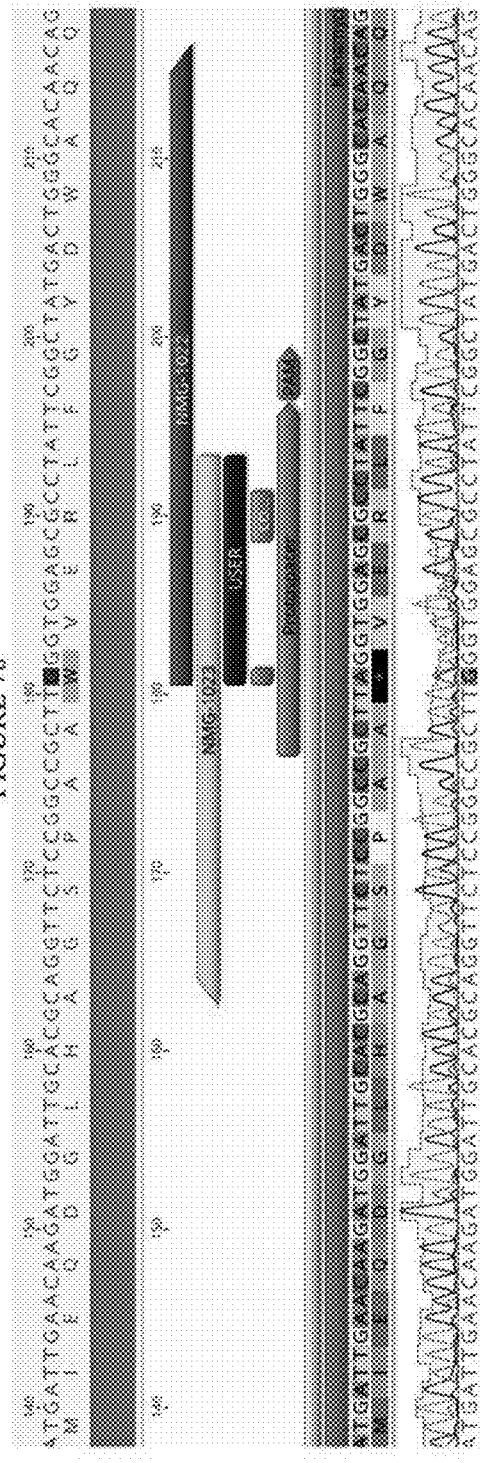
FIG. 70 shows the current editor targeting W15 stop site. The sequences correspond to SEQ ID NOs: 629-633 from top to bottom respectively.
Figure 79:
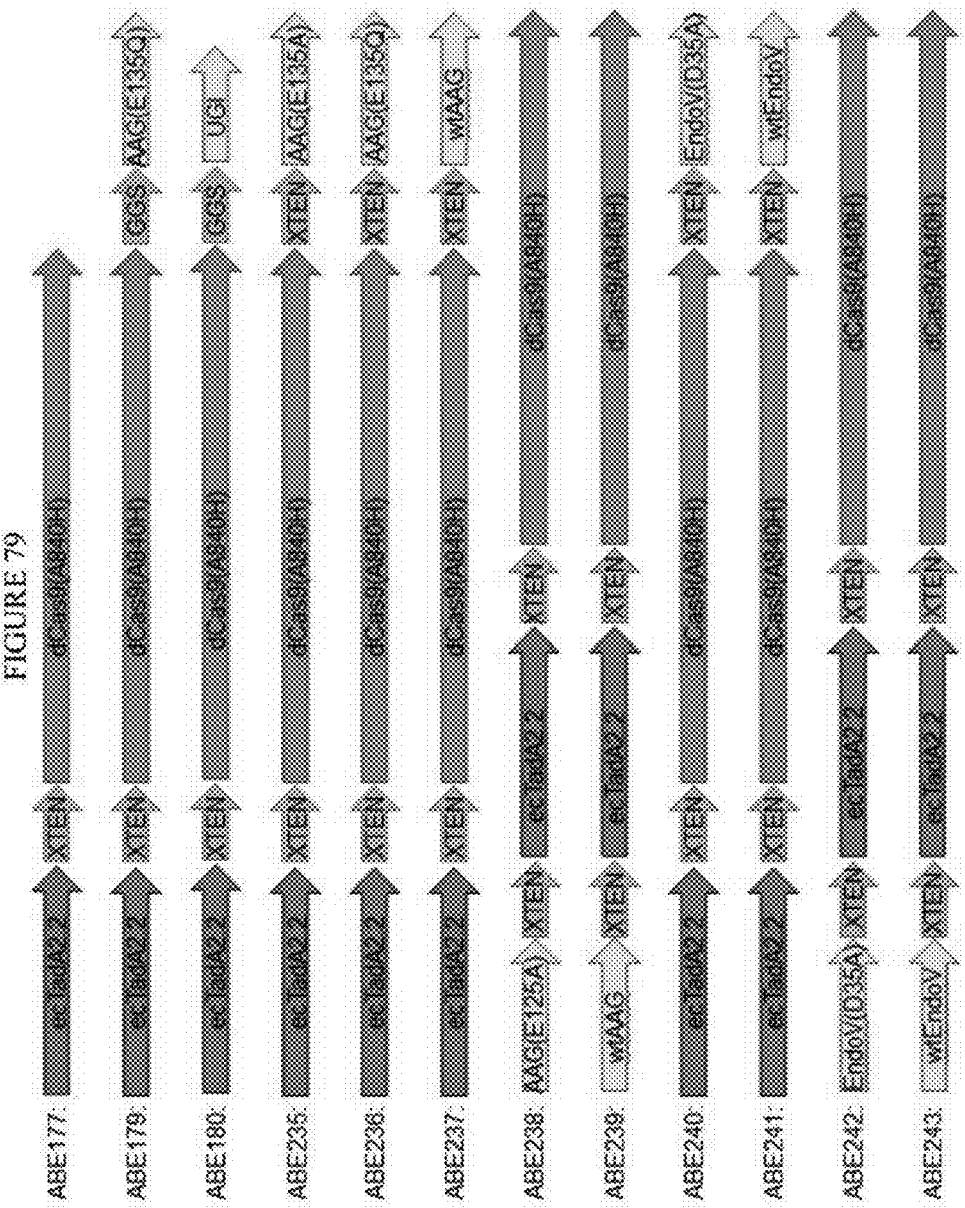
FIG. 79 shows the constructs of all inhibitors tested.
Figure 80:
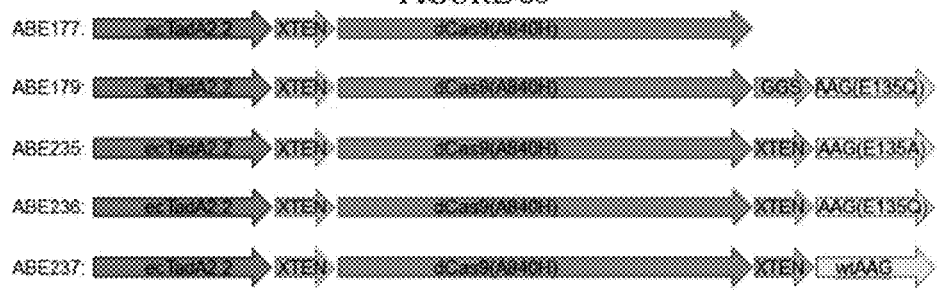
FIG. 80 shows the constructs used when tethering AAG to ABE.
Figure 81:
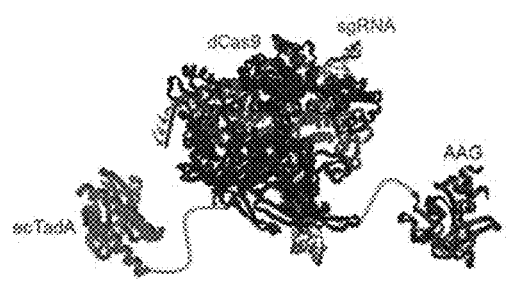
FIG. 81 is a schematic showing the tethering of AAG to ABE.
Figures 82, 83:
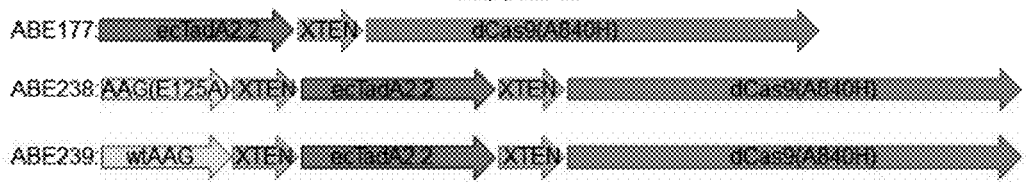
FIG. 82 shows the results of tethering AAG to ABE.
FIG. 83 shows the constructs used when tethering AAG to ABE with an N-terminus of TadA.
Figures 84, 85:
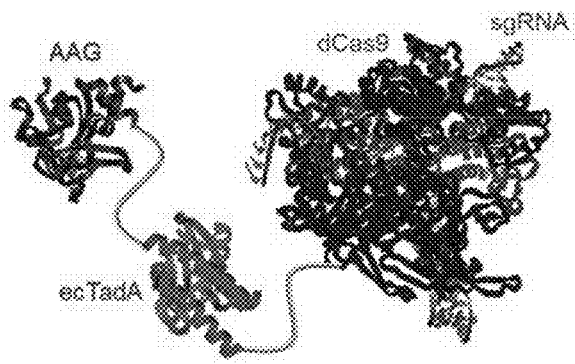
FIG. 84 is a schematic showing the tethering of AAG to ABE with an N-terminus of TadA.
FIG. 85 shows the results of tethering AAG to ABE.
Figures 89, 90:
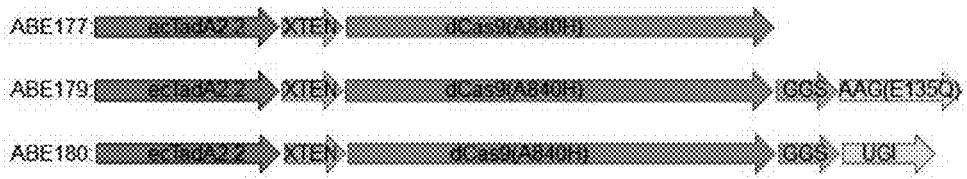
FIG. 89 shows the constructs used when tethering UGI to ABE.
FIG. 90 shows the results of tethering UGI to the end of ABE.
Figure 91:
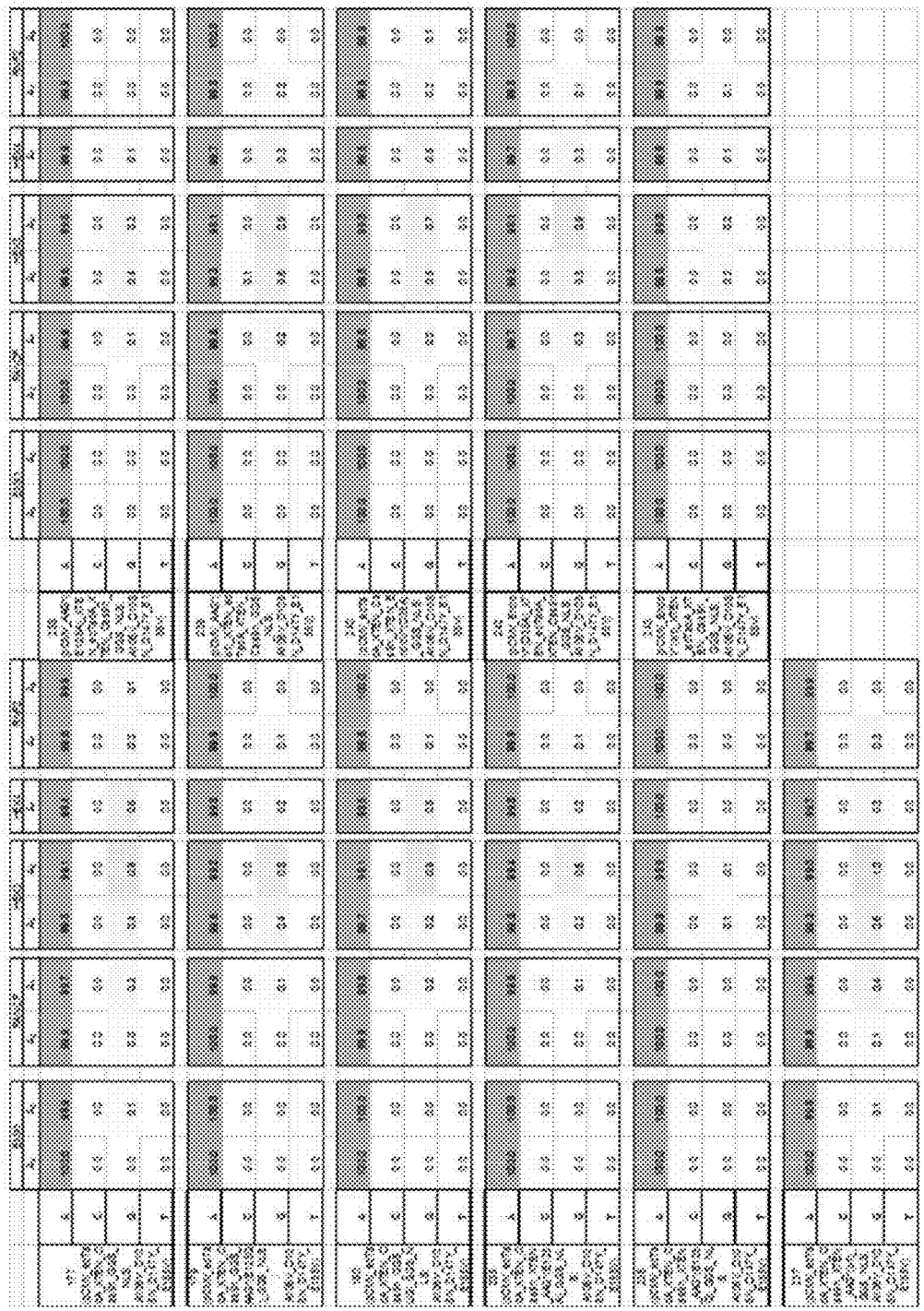
FIG. 91 shows the results of various inhibitors increasing A to G editing.

A next goal was to modify the ABE editor sequence preferences. One ABE targeted the Q4 stop site only and A to G reversion was observed, as shown in FIG. 69. Results also showed that the editor targeted the W15 stop site only and A to G reversion was observed, as shown in FIG. 70.

Sequences were different than original evolution target, which was the chloramphenicol active site. New mutations could result in a kinetically faster enzyme. The third round of evolution targeted both Q4 and W15 sites simultaneously in the kanamycin gene. Correction of two sites in the same gene, in addition to targeting sites of with sequence identity dissimilar from the original chloramphenicol gene creates greater selection stringency. The template used for evolution #3 was bacterial plasmid pNMG-288 which contained 2gRNA (targeting Q4 stop and W15 stop in kanamycin). Error-pone PCR was performed on the deaminase portion of pNMG-288 which already contained the following mutations: A106V, D108N, D147Y, E155V.

Upon creating mammalian constructs of the corresponding variants resulting from evolution round #3, it was found that pNMG-341 and pNMG-340 generally out-performed pNMG-290, which was the most highly optimized construct from evolution #2.

TABLE 5

Includes exemplary protospacer and PAM sequences. An RNA sequence complementary to the protospacer sequence in the table would be used in a gRNA to target an ABE to the sequence. The target A with respect to the original Hek-2 site (originally at position 5) is shown in bold, and nucleotides that differ from the original Hek-2 sequence are underlined. The sequences correspond to SEQ ID NOs: 445-464 from top to bottom.

| plasmid name | comment | protospacer sequence | PAM |
|---|---|---|---|
| pNMG-299 | other sites within HEK2 locus | GAACACAAAGCATAGACTGC | GGG |
| pNMG-301 | other sites within HEK2 locus | GGAACACAAAGCATAGACTG | CGG |
| pNMG-302 | other sites within HEK2 locus | AACACAAAGCATAGACTGCG | GGG |
| pNMG-303 | other sites within HEK2 locus | ACAAAGCATAGACTGCGGGG | CGG |
| pNMG-304 | other sites within HEK2 locus | CAAAGCATAGACTGCGGGGC | GGG |
| pNMG-305 | other sites within HEK2 locus | GTGGTAATTTTCCAGCCCGC | TGG |
| pNMG-306 | other sites within HEK2 locus | CCTTTACAGGGCCAGCGGGC | TGG |
| pNMG-307 | other sites within HEK2 locus | CTGTCACAGTTAGCTCAGCC | AGG |
| pNMG-308 | other sites within HEK2 locus | GTGTTCCAGTTTCCTTTACA | GGG |
| pNMG-300 | Hek-2 guide SEQ off-target | GAACACAATGCATAGATTGC | CGG |
| pNMG-309 | Hek-2 similar site | GAAAAAAAGCAGAGACTGC | TGG |

TABLE 5-continued

Includes exemplary protospacer and PAM sequences. An RNA sequence complementary to the protospacer sequence in the table would be used in a gRNA to target an ABE to the sequence. The target A with respect to the original Hek-2 site (originally at position 5) is shown in bold, and nucleotides that differ from the original Hek-2 sequence are underlined. The sequences correspond to SEQ ID NOs: 445-464 from top to bottom.

| plasmid name | comment | protospacer sequence | PAM |
|---|---|---|---|
| pNMG-310 | Hek-2 similar site | GAATACTAAGCATAGACTCC | AGG |
| pNMG-311 | Hek-2 similar site | GTAAACAAAGCATAGACTGA | GGG |
| pNMG-312 | Hek-2 similar site | GGACACAAAGCTTAGACTCC | AGG |
| pNMG-313 | Hek-2 similar site | CAATACAAAGGATAGACTGC | AGG |
| pNMG-314 | Hek-2 similar site | GAAGACCAAGGATAGACTGC | TGG |
| pNMG-315 | Hek-2 similar site | GAAAACAAATCATTGACTGC | AGG |
| pNMG-316 | Hek-2 similar site | GATCACAAAGCATGGACTGA | AGG |
| pNMG-317 | Hek-2 similar site | GAAAACAAAACATAGAGTGC | TGG |
| pNMG-318 | Hek-2 similar site | GAACATAAAGAATAGAATGA | TGG |

Example 3

Evolution of Adenosine Base Editor Containing the A106V, D108N, D147Y, and E155V Mutations of ecTadA (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resitance gene which require two A to G reversions (both in premature stop codons) to confer kanamycin resistance. The 2 gRNA/2 target approach was used to increase the stringency of the selection. See FIGS. 96-99. This evolution resulted in the identification of the following new mutations: L84F, H123Y and I157F.

Evolution #3 was performed analogously as evolution number 1 and 2, except bacterial plasmid pNMG-288 was used as a template, mutations in ecTadA (A106V_D108N_D147Y_E155V) and 2 gRNA expressed to target stop codons in selection plasmid pNMG-27-(Q4term+W15term). Libraries were plated on concentrations of kanamycin above the MIC. The most efficient base editor from evolution #3 was pNMG-371, which contains two ecTadA domains comprising the mutations L84F, A106V, D108N, H123Y, D147Y, E155V, and I156F.

Example 4

Evolution of Adenosine Base Editor ecTadA Residues E25, R26, R107, A142, and A143 to Increase Editing Efficiency of Adenine in Non-YAC Sequences (Evolution #4)

An ecTadA bacterial codon-optimized construct with the consensus mutations from evolution #2, A106V, D108N, D147Y and E155V, which is composed of one unit of ecTadA, an XTEN linker, and catalytically inactive Cas9 (dCas9), was mutagenized using NNK primers that target sites in ecTadA (e.g., E25, R26, R107, A142 and A143) to generate a site-saturated ABE library. Residues E25, R26, R107, A142 and A143 of ecTadA are hypothesized to make contact with the tRNA substrate with the wt ecTadA homodimer. For the NNK primers, N is A, T, C, or G, and K is G or T. The primers contain the mutations and are designed to bind at the 5 regions of interest, and a full-length product is obtained using PCR overlap extension protocol and assembled using USER junctions as used previously in the error-prone library assemblies. The 5 residues of ecTadA that were targeted included E25, R26, R107, A142 and A143. A goal of this evolution was to modify the "YAC" sequence preference of the adenosine base editor. In this round of evolution, the library of ABEs was selected against a spectinomycin resistance gene whose target A was presented in a non-YAC context. See FIGS. 101-123. The results from this round of evolution yielded mutations: R26G and A142N.

The ecTadA_2.2 deaminase construct was mutagenized to target active site residue in spectinomycin (T89). The gRNA targeted region: 5'-CAATGATGACTTCTACAGCG-3' (SEQ ID NO: 444) corresponds to a non "YAC" sequence. The targeted residues and their respective interactions are shown in Table 6.

TABLE 6

Shows the amino acid residues in saTadA and ecTadA responsible for the specifically listed interactions. The size of the library used in evolution #4 is $32^5$, which is the size of the library based on codon frequency.

| S. aureus TadA | E. coli TadA | interaction |
|---|---|---|
| G22 | E25/R26 | carbonyl H-bond to 3' C tRNA substrate |
| D103 | R107 | carbonyl H-bond to 5' U in tRNA substrate |
| S138 | A142/A143 | carbonyl H-bond to 5' U in tRNA substrate |

The NNK library with ecTadA_2.2 deaminase template was generated from approximately 500 colonies total from plates containing 128, 256, 384 and 512 of ug/mL spectinomycin. The editor constructs were sub-cloned, re-transformed into S1030 with uncorrected spectinomycin T89I selection plasmid and re-challenged with increasing concentrations of spectinomycin to clarify the true positive phenotypes from random reversions. The editing results of the evolution #4 variants (NNK library) at sites HEK-2, HEK2-3, HEK2-6, HEK2-7, HEK2-10, HEK3, and FANCF sites are shown in FIGS. 108 through 122. The evolution #4 variants do not perform better than the evolution #3 variants and do not demonstrate a relaxed substrate specificity with respect to the "YAC" sequence.

The results of the evolution #4 mammalian transfection for sites HEK-2, HEK2-2, HEK2-3, HEK2-6, HEK2-7, and HEK2-10 sites are shown in FIG. 123. The ecTadA evolution round #4 mutations neither improve editing efficiencies nor broadened substrate tolerance.

The evolution #4 template for evolution for the target sites in ecTadA (A106V, D108N, D147Y, E155V) is given in Table 7, which identifies individual clones that were identified.

TABLE 7

Mutations identified in Evolution #4. The template for evolution: ecTadA (A106V, D108N, D147Y, and E155V).

| clone: | 25 | 26 | 107 | 142 | 143 |
|---|---|---|---|---|---|
|  | E | R | R | A | A |
| PLATE 1 |  |  |  |  |  |
| 1 |  | M | G | P | N | D |
| 2 |  | D | G | K | N | G |
| 3 |  |   | N | A | N |   |
| 4 |  |   | Q |   | N |   |
| 5 |  | A | G | N | N | E |
| 6 |  |   | G | W | N |   |
| 7 |  |   |   |   | N | L |
| 8 |  | A | C |   | N | W |
| PLATE 2 |  |  |  |  |  |
| 9 |  | D | G | K | N | G |
| 10 |  | R |   |   | N | L |
| 11 |  |   |   | H | N | M |
| 12 |  | M | G | P | N | D |
| 13 |  |   | Q |   | N |   |
| 14 |  | M | G |   | N | D |
| 15 |  |   | L |   | N | L |
| 16 |  | R |   |   | N | L |
| PLATE 3 |  |  |  |  |  |
| 17 |  |   | C | H | N |   |
| 18 |  |   | G | H | N | G |
| 19 |  | V | G | S | D | S |
| 20 |  |   | Q |   | N |   |
| 21 |  | S | C |   | N | Q |
| 22 |  | Y | K |   | G | R |

Example 5

Evolution of Adenosine Base Editor Containing the L84F, A106V, D108N, H123Y, D147Y, E155V, and I157F Mutations of ecTadA (Evolution #5)

An ecTadA construct containing mutations from evolution #3, L84F, A106V, D108N, H123Y, D147Y, E155V, I157F (pNMG-325) was mutagenized with error-prone PCR and the resulting ABE library was targeted with 2 separate gRNAs to two different loci in two different antibiotic resistant genes: chloramphenicol and spectinomycin. Both target sequences contained a target A in a non-YAC context.

The editor plasmid encodes two different gRNA: chlor and spect, both of which are "non-YAC" targets. The chlor target sequence is 5'-TACGGCGTAGTGCACCTGGA-3' (SEQ ID NO: 441) and has a target "A" at position "9." The spect target sequence is 5'-CAATG ATGACTTCTACAGCG-3 (SEQ ID NO: 444) and has a target "A" at position "6." A schematic of the construct containing ecTadA and dCas9 used for ecTadA evolution (evolution #5) is shown in FIG. 124.

The library was transformed into S1030+selection plasmid, ABE expressed for 7 hours before plating on selection media: 128 ug/mL chloramphenicol (+kan/carb), 128 ug/mL chloramphenicol, 128 ug/mL spectinomycin (+kan/carb), 128 ug/mL chloramphenicol, 256 ug/mL spectinomycin (+kan/carb), 128 ug/mL chloramphenicol, 384 ug/mL spectinomycin (+kan/carb). The results of the clones assayed after fifth evolution #5 are shown in FIGS. 125 through 128. Surviving colonies are shown. The amplicons from spect selection clones assayed after evolution #5 are shown in FIG. 127. All colonies sequenced from double selection plates did not have any new mutations relative to the starting material.

Example 6

Examination of Mutations Introduced into the *S. aureus* TadA

Mutations were introduced into the *S. aureus* TadA (saTadA) based on the published crystal structure in Losey H. C., et al., "Crystal structure of *Staphylococcus aureus* tRNA adenosine deaminase TadA in complex with RNA," *Nature Stuctural and Molecular Biology*, 13, p. 153-159 (2006); the entire contents of which are hereby incorporated by reference. Based on the crystal structure of *S. aureus* TadA bound to its native tRNA substrate, 4 residues were selected for mutagenesis which made H-bond contact with the anticodon loop of the substrate. A first goal was to determine whether or not another version of an ABE editor could be made that could induce A to G mutations in DNA. For example, by using a TadA from another bacterial species (e.g., *S. aureus*). A second goal was to determine if the sequence specificity of a *S. aureus* editor was similar or different than the an ecTadA editor. A third goal was to test whether the editing efficiencies of an *S. aureus* ABE editor are improved as compared to an *E. coli* ABE editor. Briefly, mutations D104N, D103A, G22P, and S138A were made in saTadA. See constructs pNMG-345-350 in Table 4. The editing results of base editing at sites HEK-2, HEK2-1, HEK2-2, HEK2-3, HEK2-4, HEK2-6, HEK2-9, HEK2-10, HEK3, RNF2, and FANCF sites are shown in FIGS. 129 through 139. These figures show that mutations identified in ecTadA can be made in *S. Aureus* TadA (saTadA) to confer the ability of saTadA to deaminate adenine in DNA. The figures also show that the YAC sequenc preference is similar for saTadA as it is for ecTadA.

Example 7

Testing ecTadA Homodimers Vs Heterodimers and Linker Lengths of Adenosine Base Editors Adenosine base editor constructs were generated to test various linker lengths and various combinations of adenosine deaminase (e.g., wild-type ecTadA and/or mutant ecTadA domains) domains. For each construct the efficiency of mutating a target A to a G was tested. For example, constructs pNMG 492-500 and pNMG-513-518 were tested for their ability to generate A to G mutations in the DNA of cells. The identities of constructs pNMG 492-500 and pNMG-513-551 are shown in Table 4. Results of these tests are shown, for example, in FIGS. 141-149. Further, arginine residues within the adenosine deaminase of base editors were mutated to determine whether they had an effect on target sequence specificity, for example, their ability to mutate an A that is not part of a 5'-YAC-3' sequence, where Y is C or T, was tested. Results of these tests are shown, for example, in FIG. 141.

TABLE 8 sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-260 | RNF-multiA | AGAAAAACAATTTTAGTATT | 476 |
| pNMG-261 | HEK3-multiA | GCAGAAATAGACTAATTGCA | 477 |
| pNMG-299 | HEK2 | GAACACAAAGCATAGACTGC | 478 |
| pNMG-300 | HEK2 guideseq | GAACACAATGCATAGATTGC | 479 |
| pNMG-301 | HEK2-2 | GGAACACAAAGCATAGACTG | 480 |
| pNMG-302 | HEK2-3 | AACACAAAGCATAGACTGCG | 481 |
| pNMG-303 | HEK2-4 | ACAAAGCATAGACTGCGGGG | 482 |
| pNMG-304 | HEK2-5 | CAAAGCATAGACTGCGGGGC | 483 |
| pNMG-305 | HEK2-6 | GTGGTAATTTTCCAGCCCGC | 484 |
| pNMG-306 | HEK2-7 | CCTTTACAGGGCCAGCGGGC | 485 |
| pNMG-307 | HEK2-8 | CTGTCACAGTTAGCTCAGCC | 486 |
| pNMG-308 | HEK2-9 | GTGTTCCAGTTTCCTTTACA | 487 |
| pNMG-309 | HEK2 similar 1 | GAAAAAAAGCAGAGACTGC | 488 |
| pNMG-310 | TAC (HEK2 similar 2) | GAATACTAAGCATAGACTCC | 489 |
| pNMG-311 | AAC (HEK2 similar 3) | GTAAACAAAGCATAGACTGA | 490 |
| pNMG-312 | HEK2 similar 4 | GGACACAAAGCTTAGACTCC | 491 |
| pNMG-313 | HEK2 similar 5 | CAATACAAAGGATAGACTGC | 492 |
| pNMG-314 | GAC (HEK2 similar 6) | GAAGACCAAGGATAGACTGC | 493 |
| pNMG-315 | HEK2 similar 7 | GAAAACAAATCATTGACTGC | 494 |
| pNMG-316 | HEK2 similar 8 | GATCACAAAGCATGGACTGA | 495 |
| pNMG-317 | HEK2 similar 9 | GAAAACAAAACATAGAGTGC | 496 |
| pNMG-318 | CAT (HEK2 similar 10) | GAACATAAAGAATAGAATGA | 497 |
| pNMG-380 | R1329* SCN1A | AATCAAGATAAGGCTCTTAG | 498 |
| pNMG-423 | R580* SCN1A | GCTCACCCTCTAAAGCTGAAA | 499 |
| pNMG-424 | C136Y PTEN (MDA-MB-415) | GTATATGCATATTTATTACAT | 500 |
| pNMG-425 | Q144* TP53 (NCI-H2171) | GCAGCTACACAGGGCAGGTCT | 501 |

TABLE 8-continued sgRNA Plasmid key. The plasmid key below
contains the protospacer sequence of the
sgRNA sequence and identifies the reference plasmid number and site. For the
protospacer sequence, the T is a U in
the gRNA. In some embodiments, any of the
gRNAs provided herein comprise any of the
protospacer sequences in Table 8, where T
is U.

| plasmid number | site | protospacer | SEQ ID NO: |
|---|---|---|---|
| pNMG-426 | R306* TP53 (HCC1937) | GACCTCACTTAGTGCTCCCTG | 502 |
| pNMG-463 | CAG | GGACAGGCAGCATAGACTGT | 503 |
| pNMG-464 | GAA | GTAGAAAAGTATAGACTGC | 504 |
| pNMG-465 | GAG | GGAGAGAGAGCATAGACTGC | 505 |
| pNMG-466 | GAT | GAAGATAGAGAATAGACTGC | 506 |
| pNMG-467 | TAA | GGCTAAAGACCATAGACTGT | 507 |
| pNMG-468 | TAG | GTCTAGAAAGCTTAGACTGC | 508 |
| pNMG-469 | TAT | GAGTATGAGGCATAGACTGC | 509 |
| pNMG-470 | AAG | GTCAAGAAAGCAGAGACTGC | 510 |
| pNMG-471 | AAT | GGGAATAAATCATAGAATCC | 511 |
| pNMG-472 | CAA | GAGCAAAGACAATACACTGT | 512 |
| pNMG-501 | AAA | GACAAAGAGGAAGAGAGACG | 513 |
| pNMG-502 | SITE 2 | GGGGACGCGCTGGCTTCCCG | 514 |
| pNMG-503 | SITE 3 | GGACCGGCTCCCTGGCGGTC | 515 |
| pNMG-504 | SITE 4 | GCCACTTCTAAGCCCTTGAT | 516 |
| pNMG-505 | SITE 5 | GGGAAAGACCCAGCATCCGT | 517 |
| pNMG-506 | SITE 6 | GCGGTACGCCGCTTCAGTGA | 518 |
| pNMG-507 | SITE 7 | GAAACTGGTCCCGTTTACAG | 519 |
| pNMG-508 | SITE 8 | GATGAGATAATGATGAGTCA | 520 |
| pNMG-509 | SITE 9 | GCCTAGGCAGTGGGGTGCA | 521 |
| pNMG-510 | R196* TP53 (Calu-6) | GACTCAGATAAGATGCTGAGG | 522 |
| pNMG-511 | M237I TP53 (T98G) | GCATATGTAACAGTTCCTGCA | 523 |
| pNMG-512 | R273H TP53 (NCI-H1975) | GTGCATGTTTGTGCCTGTCC | 524 |
| pNMG-531 | EMX1-5 | GGGGATGGCAGGGCAGGAAG | 525 |
| pNMG-532 | EMX1-6 | GGGTTAGGGGCCCCAGGCCG | 526 |
| pNMG-533 | FANCF-7 | GGATGCAGCTCGTTACCACC | 527 |
| pNMG-534 | FANCF-5 | GCGCACGGTGGCGGGGTCCC | 528 |
| pNMG-535 | HEK3-6 | GGGCCAGGTCCCTCCTCTCC | 529 |
| pNMG-536 | HEK3-7 | GGATTGACCCAGGCCAGGGC | 530 |
| pNMG-537 | HEK4-5 | GATGACAGGCAGGGCACCG | 531 |
| pNMG-538 | HEK4-6 | GGGCCAGTGAAATCACCCTG | 532 |
| pNMG-539 | RNF2-5 | GGGGACTTTGGGAGGTGATC | 533 |
| pNMG-540 | RNF2-6 | GCACCAGCAGATGCAGTGTC | 534 |
| pNMG-601 | RNF2-6 | GACACACACACTTAGAATCTG | 535 |
| pNMG-602 | RNF2-6 | GCACACACACTTAGAATCTGT | 536 |

Example 8

DNA Shuffling Using Nucleotide Exchange and Excision Technology (NExT) to Remove Epistatic Mutations, Evolution #6

To generate more efficient adenosine base editors and remove potential epistatic mutations constructs from evolutions 4, 5a, 5b and 2 were subjected to DNA shuffle experiments using Nucleotide Exchange and Excision Technology (NExT). A schematic representation of DNA shuffling is shown in FIGS. 150 and 151. Briefly, a DNA shuffle library was created. NExT shuffle and USER assembly, were transformed into 10B cells. The isolated DNA shuffle library was transformed into S1030 with selection plasmid. Plating was performed using 4 different selection conditions, including, low chlor, high chlor, high spect, and chlor plus spect after 7 hours of adenosine base editor induction. Incubation was performed at 37C for 48 hours then colony PCR was performed on survivors. See FIGS. 150 and 151.

The sequence identity of the clones obtained from evolution #6 is shown in FIGS. 152 and 153. The mutations are given relative to SEQ ID NO: 1. FIG. 154 contains schematic representations of base editors derived from evolution #6. Evolution #6 identified mutations in P48 (e.g., P48T, P48S and P48A) and A142 (e.g., A142N), relative to SEQ ID NO: 1. These mutations improved the efficiency of base editors to mutate an A residue to a G in DNA. See, for example, the experimental results in FIGS. 155-158.

Example 9

Evolving Adenosine Base Editors to Efficiently Edit Multi A Sites, Evolution #7

To generate base editors that are more efficient at editing an A within a site containing multiple A residues (e.g., a 5'-AAA-3' sequence), base editors capable of editing a multi-A site were evolved. Evolution was performed by identifying evolved base editors that could correct two point mutations that conferred the ability of cells to be antibiotic (kan) resistant. See, for example, FIGS. 163-165. Mutations that improve base editing efficiency and/or the ability to edit an A at a multi-A site are shown in FIG. 164, where mutations are identified relative to SEQ ID NO: 1. Evolution #7 identified mutations in W23 (e.g., W23R, and W23L) and R152 (e.g., R152P, and R152H), relative to SEQ ID NO: 1. A summary of base editing efficiency for selected adenosine base editor constructs on various target sequences is shown in FIGS. 179-186. Tables 9 and 10 contain bacterial selection plasmid data.

TABLE 9

Bacterial selection plasmid data.

| selection plasmid | corresponding editor + gRNA | modification | protospacer (targeted selection) | position of target | strand modification | origin | MIC (S1030) Kan |
|---|---|---|---|---|---|---|---|
| pNMG-208 | pNMG-255 | stop in Kan gene, W15 | 5'-GCTTAGGTGGAGCGCCTATT-3' (SEQ ID NO: 707) | 5 | coding | RSF1030 | 32 ug/mL |
| pNMG-209 | pNMG-257 | stop in Kan gene, R18 | 5'-AGTCACTCCACCCAAGCGGC-3' (SEQ ID NO: 708) | 5 | template | RSF1030 | 256 ug/mL |
| pNMG-210 | pNMG-259 | stop in Kan gene, R 44 | 5'-GTCACCCCTGCGCTGACAGC-3' (SEQ ID NO: 709) | 4 | template | RSF1030 | 128 ug/mL |
| pNMG-211 | pNMG-253 | stop in Kan gene, Q4 | 5'-ATCTTATTCGATCATGCGAA-3' (SEQ ID NO: 710) | 6 | template | RSF1030 | 16 ug/mL |
| pNMG-212 | n/a | wt Kan gene | control plasmid | n/a | n/a | RSF1030 | >1056 ug/mL |
| pNMG-213 | pNMG-255 | pNMG-208 w/SD8 RBS | 5'-GCTTAGGTGGAGCGCCTATT-3' (SEQ ID NO: 711) | 5 | template | RSF1030 | 528 ug/mL |
| pNMG-214 | pNMG-255 | pNMG-208 w/SD3 RBS | 5'-GCTTAGGTGGAGCGCCTATT-3' (SEQ ID NO: 712) | 5 | template | RSF1030 | 128 ug/mL |
| pNMG-215 | pNMG-255 | pNMG-208 w/SD2 RBS | 5'-GCTTAGGTGGAGCGCCTATT-3' (SEQ ID NO: 713) | 5 | template | RSF1030 | unknonwn |
| pNMG-216 | n/a | 2 stop, Q4 + R18 | 5'-ATCTTATTCGATCATGCGAA-3' (SEQ ID NO: 714), 5'-AGTCACTCCACCCAAGCGGC-3' (SEQ ID NO: 715) | 6 + 5 | template | RSF1030 | 8 ug/mL |
| pNMG-217 | n/a | 2 stop, W15 + R44 | 5'-GCTTAGGTGGAGCGCCTATT-3' (SEQ ID NO: 716), 5'-GTCACCCCTGCGCTGACAGC-3' (SEQ ID NO: 717) | 5 + 4 | both | RSF1030 | 8 ug/mL |
| pNMG-221 | n/a | 2 stop, W15 + R44 | 5'-GCTTAGGTGGAGCGCCTATT-3' (SEQ ID NO: 718), 5'-GTCACCCCTGCGCTGACAGC-3' (SEQ ID NO: 719) | 5 + 4 | both | CloDF13 | 4 ug/mL |

TABLE 10

Bacterial selection plasmid data

| selection plasmid | corresponding editor + gRNA | original Chlor selection | 5'-TACGGCGTAGTGCACCTGGA-3' (SEQ ID NO: 441) silent mutations in chlor site in italics, bold is target A: | 9 | template | RSF 1030 | (S1030) Chlor 1 ug/mL | SEQ ID NO: |
|---|---|---|---|---|---|---|---|---|
| pNMG-186 | pNMG-197 | original chlor site (H193Y) | 5'-TAC*T*G*T*GTAAT*GTA*TCTGGA-3' | 9 | template | RSF 1030 | 1 ug/mL | 720 |
| pNMG-187 | pNMG-198 | original chlor site (H193Y) | 5'-TAC*T*GCGTAGTGCACCTGGA-3' | 9 | template | RSF 1030 | 1 ug/mL | 721 |
| pNMG-188 | pNMG-199 | original chlor site (H193Y) | 5'-TAC*C*GCGTAGTGCACCTGGA-3' | 9 | template | RSF 1030 | 1 ug/mL | 722 |

TABLE 10-continued

Bacterial selection plasmid data

| selection plasmid | original Chlor selection | | 5'-TACGGCGTAGTGCACCTGGA-3' (SEQ ID NO: 441) silent mutations in chlor site in italics, bold is target A: | 9 | | (S1030) RSF template | Chlor 1030 1 ug/mL | SEQ ID NO: |
|---|---|---|---|---|---|---|---|---|
| pNMG-189 | pNMG-200 | original chlor site (H193Y) | 5'-TACAGCGTAGTGCACCTGGA-3' | 9 | | template | RSF 1030 | 1 ug/mL | 723 |
| pNMG-190 | pNMG-200 | original chlor site (H193Y) | 5'-TACGGCGTAATGCACCTGGA-3' | 9 | | template | RSF 1030 | 1 ug/mL | 724 |
| pNMG-191 | pNMG-201 | original chlor site (H193Y) | 5'-TACGGCATAGTGCACCTGGA-3' | 9 | | template | RSF 1030 | 1 ug/mL | 725 |
| pNMG-192 | pNMG-202 | original chlor site (H193Y) | 5'-TACGGCGTAGTGTACCTGGA-3' | 9 | | template | RSF 1030 | 1 ug/mL | 726 |
| pNMG-193 | pNMG-203 | original chlor site (H193Y) | 5'-TACGGCGTAGTGGACCTGGA-3' | 9 | | template | RSF 1030 | 1 ug/mL | 727 |
| pNMG-194 | pNMG-204 | original chlor site (H193Y) | 5'-TACGGCGTAGTGAACCTGGA-3' | 9 | | template | RSF 1030 | 1 ug/mL | 728 |
| pNMG-195 | pNMG-205 | original chlor site (H193Y) | 5'-TACGGCGTAGTGCACTTGGA-3' | 9 | | template | RSF 1030 | 1 ug/mL | 729 |
| pNMG-196 | pNMG-206 | original chlor site (H193Y) | 5'-CGTAGTGCACCTGGATGGCC-3' | 4 | | template | RSF 1030 | 1 ug/mL | 730 |
| | pNMG-227 | chlor (1)_ H193Y | 5'-TACCGCGTAGTGAACTTGGA-3' | 9 | | | | 1 ug/mL | 731 |
| | pNMG-228 corresponding editor +2 gRNA target Kan only | chlor (2)_ H193Y | 5'-TACCGCATAGTGAACTTGGA-3' | 7 + 9 | | | | 1 ug/mL | 732 |
| pNMG-270 | pNMG-288 | stop in Kan gene, W15STOP | 5'-GCTTAGGTGGAGCGCCTATT-3' | 5 | | coding | RSF 1030 | | 733 |
| | | stop in Kan gene, Q4STOP | 5'-ATCTTATTCGATCATGCGAA-3' | 6 | | template | | | 734 |
| | | original Chlor selection His193Y | 5'-TACGGCGTAGTGCACCTGGA-3' | 9 | | template | | | 735 |
| pNMG-319 | | stop in Kan gene, W15STOP | 5'-GCTTAGGTGGAGCGCCTATT-3' | 5 | | coding | RSF 1030 | | 733 |
| | | stop in Kan gene, Q4STOP | 5'-ATCTTATTCGATCATGCGAA-3' | 6 | | template | | | 734 |
| | | chlor (2) | 5'-TACCGCATAGTGAACTTGGA-3' | 7 + 9 | | + template | | | 732 |
| pNMG-333 | round 4, evolve against spect only | spect gene: T89I mutation | 5'-CAATGATGACTTCTACAGCG-3' | 6 | | template | RSF 1030 | | 736 |

TABLE 10-continued

Bacterial selection plasmid data

| selection plasmid | original Chlor selection | silent mutations in chlor site in italics, bold is target A: | 5'-TACGGCGTAGTGCACCTGGA-3' (SEQ ID NO: 441) 9 | RSF template | (S1030) Chlor 1030 1 ug/mL | SEQ ID NO: |
|---|---|---|---|---|---|---|
| | round 5: chlor + spect | chlor gene: H193Y mutation | 5'-TACGGCGTAGTGCACCTGGA-3' 9 | template | | 737 |
| | round 6: spect + chlor | | | | | |
| pNMG-570 | round 7, evolve against two mutations, same gene | kan gene D208N mutation | 5'-TTCATTAACTGTGGCCGGCT-3' 7 | coding | RSF 1030 | 738 |
| | kanamycin (Q4sop and D208N reversion needed) | | 5'-ATCTTATTCGATCATGCGAA-3' 6 | template | | 739 |

Example 10

Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterek, of a Cas9 protein may be mutated. In some embodiments, the D10 and/or H840 residues of the amino acid sequence provided in SEQ ID NO: 52, or a corresponding mutation in any of the amino acid sequences provided in SEQ ID NOs: 108-357, are mutated. In some embodiments, the D10 residue of the amino acid sequence provided in SEQ ID NO: 52, or a corresponding mutation in any of the amino acid sequences provided in SEQ ID NOs: 108-357, is mutated to any amino acid residue, except for D. In some embodiments, the D10 residue of the amino acid sequence provided in SEQ ID NO: 52, or a corresponding mutation in any of the amino acid sequences provided in SEQ ID NOs: 108-357, is mutated to an A. In some embodiments, the H840 residue of the amino acid sequence provided in SEQ ID NO: 52, or a corresponding residue in any of the amino acid sequences provided in SEQ ID NOs: 108-357, is an H. In some embodiments, the H840 residue of the amino acid sequence provided in SEQ ID NO: 52, or a corresponding mutation in any of the amino acid sequences provided in SEQ ID NOs: 108-357, is mutated to any amino acid residue, except for H. In some embodiments, the H840 residue of the amino acid sequence provided in SEQ ID NO: 52, or a corresponding mutation in any of the amino acid sequences provided in SEQ ID NOs: 108-357, is mutated to an A. In some embodiments, the D10 residue of the amino acid sequence provided in SEQ ID NO: 52, or a corresponding residue in any of the amino acid sequences provided in SEQ ID NOs: 108-357, is a D.

A number of Cas9 sequences from various species were aligned to determine whether corresponding homologous amino acid residues of D10 and H840 of SEQ ID NO: 52 or SEQ ID NO: 108 can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties-11,-1; End-Gap penalties-5,-1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 108 | WP_0109222511 gi 499224711 | type II CRISPR RNA-guided endonuclease Cas9 [*Streptococcus pyogenes*]; Sequence 2 (S2): SEQ ID NO: 109 | WP_039695303 I gi 746743737 I type II CRISPR RNA-guided endonuclease Cas9 [*Streptococcus gallolyticus*]; Sequence 3 (S3): SEQ ID NO: 110 | WP_045635197 | gi 782887988 I type II CRISPR RNA-guided endonuclease Cas9 [*Streptococcus mitis*]; Sequence 4 (S4): SEQ ID NO: 111 | 5AX_A | gi 924443546 | *Staphylococcus Aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1  1    --MDKK-YSIGLD*IGTNSVGWAVITDEYKVESKKFKVLGNTDRHSIKKNLI--GALLFDSG--ETAEATRLKRTARRRYT 73
S2  1    --MTKKNYSIGLD*IGTNSVGWAVITDDYKVPAKKMKVLGNTDKKYIKKNLL--GALLFDSG--ETAEATRLKRTARRRYT 74
S3  1    --M-KKGYSIGLD*IGTNSVGFAVITDDYKVPSKKMKVLGNTDKRFIKKNLI--GALLFDEG--TTAEARRLKRTARRRYT 73
S4  1    GSHMKRNYILGLD*IGITSVGYGII--DYET----------------RDVIDAGVRLFKEANVENNEGRRSKRGARRLKR 61
```

```
S1   74 RRKNRICYLQEIFSNEMAKVDDSFFHRLEESFLVEEDKKHERHPIFGNIVDEVAYHEKYPTIYHLRKKLVDSTDKADLRL  153
S2   75 RRKNRLRYLQEIFANEIAKVDESFFQRLDESFLTDDDKTFDSHPIFGNKAEEDAYHQKFPTIYHLRKHLADSSEKADLRL  154
S3   74 RRKNRLRYLQEIFSEEMSKVDSSFFHRLDDSFLIPEDKRESKYPIFATLTEEKEYHKQFPTIYHLRKQLADSKEKTDLRL  153
S4   62 RRRHRIQRVKKLL--------------FDYNLLTD--------------------HSELSGINPYEARVKGLSQKLSEEE  107

S1  154 IYLALAHMIKFRGHFLIEGDLNPDNSDVDKLFIQLVQTYNQLFEENPINASGVDAKAILSARLSKSRRLENLIAQLPGEK  233
S2  155 VYLALAHMIKFRGHFLIEGELNAENTDVQKIFADFVGVYNRTFDDSHLSEITVDVASILTEKISKSRRLENLIKYYPTEK  234
S3  154 IYLALAHMIKYRGHFLYEEAFDIKNNDIQKIFNEFISIYDNTFEGSSLSGQNAQVEAIFTDKISKSAKRERVLKLFPDEK  233
S4  108 FSAALLHLAKRRG----------------------VHNVNEVEEDT----------------------------------  131

S1  234 KNGLFGNLIALSLGLTPNFKSNFDLAEDAKLQLSKDTYDDDLDNLLAQIGDQYADLFLAAKNLSDAILLSDILRVNTEIT  313
S2  235 KNTLFGNLIALALGLQPNFKTNFKLSEDAKLQFSKDTYEEDLEELLGKIGDDYADLFTSAKNLYDAILLSGILTVDDNST  314
S3  234 STGLFSEFLKLIVGNQADFKKHFDLEDKAPLQFSKDTYDEDLENLLGQIGDDFTDLFVSAKKLYDAILLSGILTVTDPST  313
S4  132 -----GNELS-----------------TKEQISRN---------------------------------------------  144

S1  314 KAPLSASMIKRYDEHHQDLTLLKALVRQQLPEKYKEIFFDQSKNGYAGYIDGGASQEEFYKFIKPILEKM--DGTEELLV  391
S2  315 KAPLSASMIKRYVEHHEDLEKLKEFIKANKSELYHDIFKDKNKNGYAGYIENGVKQDEFYKYLKNILSKIKIDGSDYFLD  394
S3  314 KAPLSASMIERYENHQNDLAALKQFIKNNLPEKYDEVFSDQSKDGYAGYIDGKTTQETFYKYIKNLLSKF--EGTDYFLD  391
S4  145 ----SKALEEKYVAELQ--------------------------------------------LERLKKDG------  165

S1  392 KLNREDLLRKQRTFDNGSIPHQIHLGELHAILRRQEDFYPPFLKDNREKIEKILTFRIPYYVGPLARGNSRFAWMTRKSEE  471
S2  395 KIEREDFLRKQRTFDNGSIPHQIHLQEMHAILRRQGDYYPPFLKEKQDRIEKILTFRIPYYVGPLVRKDSRFAWAEYRSDE  474
S3  392 KIEREDFLRKQRTFDNGSIPHQIHLQEMNAILRRQGEYYPPFLKDNKEKIEKILTFRIPYYVGPLARGNRDFAWLTRNSDE  471
S4  166 --EVRGSINRFKTSD--------YVKEAKQLLKVQKAYHQLDQSFIDTYIDLLETRRTYYEGP--GEGSPFGW------K  227

S1  472 TITPWNFEEVVDKGASAQSFIERMTNFDKNLPNEKVLPKHSLLYEYFTVYNELTKVKYVTEGMRKPAFLSGEQKKAIVDL  551
S2  475 KITPWNFDKVIDKEKSAEKFITRMTLNDLYLPEEKVLPKHSHVYETYAVYNELTKIKYVNEQGKE-SFFDSNMKQEIFDH  553
S3  472 AIRPWNFEEIVDKASSAEDFINKMTNYDLYLPEEKVLPKHSLLYETFAVYNELTKVKFIAEGLRDYQFLDSGQKKQIVNQ  551
S4  228 DIKEW--------------YEMLMGHCTYFPEELRSVKYAYNADLYNALNDLNNLVITRDENEK---LEYYEKFQIIEN  289

S1  552 LFKTNRKVTVKQLKEDYFKKIECFDSVEISGVEDR---FNASLGTYHDLLKIIKDKDFLDNEENEDILEDIVLTLTLFED  628
S2  554 VFKENRKVTKEKLLNYLNKEFPEYRIKDLIGLDKENKSFNASLGTYHDLKKIL-DKAFLDDKVNEEVIEDIIKTLTLFED  632
S3  552 LFKENRKVTEKDIIHYLHN-VDGYDGIELKGIEKQ---FNASLSTYHDLLKIIKDKEFMDDAKNEAILENIVHTLTIFED  627
S4  290 VFKQKKKPTLKQIAKEILVNEEDIKGYRVTSTGKPEF---TNLKVYHDIKDITARKEII---ENAELLDQIAKILTIYQS  363

S1  629 REMIEERLKTYAHLFDDKVMKQLKR-RRYTGWGRLSRKLINGIRDKQSGKTILDFLKSDGFANRNFMQLIHDDSLTFKED  707
S2  633 KDMIHERLQKYSDIFTANQLKKLER-RHYTGWGRLSYKLLINGIRNKENNKTILDYLIDDGSANRNFMQLINDDTLPFKQI  711
S3  628 REMIKQRLAQYDSLFDEKVIKALTR-RHYTGWGKLSAKLINGICDKQTGNTILDYLIDDGKINRNFMQLINDDGLSFKEI  706
S4  364 SEDIQEELTNLNSELTQEEIEQISNLKGYTGTHNLSLKAINILILDE------LWHTNDNQIAIFNRLKLVP--------  428

S1  708 IQKAQVSGQGDSLHEHIANLAGSPAIKKGILQTVKVVDELVKVMGRHKPENIVIEMARENQTT------QKGQKNSRERM  781
S2  712 IQKSQVVGDVDDIEAVVHDLPGSPAIKKGILQSVKIVDELVKVMG-GNPDNIVIEMARENQTT------NRGRSQSQQRL  784
S3  707 IQKAQVIGKTDDVKQVVQELSGSPAIKKGILQSIKIVDELVKVMG-HAPESIVIEMARENQTT------ARGKKNSQQRY  779
S4  429 -KKVDLSQQKEIPTTLVDDFILSPVVKRSFIQSIKVINAIIKKYG--LPNDIIIELAREKNSKAQKMINEMQKRNRQTN  505

S1  782 KRIEEGIKELGSQIL-------KEHPVENTQLQNEKLYLYYLQNGRDMYVDQELDINRLSD----YDVDH*IVPQSFLKDD  850
S2  785 KKLQNSLKELGSNILNEEKPSYIEDKVENSHLQNDQLFYYIQNGKDMYTGDELDIDHLSD----YDIDH*IIPQAFIKDD  860
S3  780 KRIEDSLKILASGL---DSNILKENPTDNNQLQNDRLFYYLQNGKDMYTGEALDINQLSS----YDIDH*IIPQAFIKDD  852
S4  506 ERIEEIIRTTGK---------------ENAKYLIEKIKLHDMQEGKCLYSLEAIPLEDLLNNPFNYEVDH*IIPRSVSFDN  570

S1  851 SIDNKVLTRSDKNRGKSDNVPSEEVVKKMKNYWRQLLNAKLITQRKFDN-LTKAERGGL-SELD------KAGFIKRQLV  922
S2  861 SIDNRVLTSSAKNRGKSDDVPSLDIVRARLAEWVRLYKSGLISKRKFDN-LTKAERGGL-TEAD------KAGFIKRQLV  932
S3  853 SLDNRVLTSSKDNRGKSDNVPSIEVVQKRKAFWQQLLDSKLISERKFNN-LTKAERGGL-DERD------KVGFIKRQLV  924
S4  571 SFNNKVLVKQEEASKKGNRTPFQYLSSSDSKISYETFKKHILNLAKGKGRISKTKKEYLLEERDINRFSVQKDFINRNLV  650

S1  923 ETRQITKHVAQILDSRMNTKYDENDKLIREVKVITLKSKLVSDFRKDFQFYKVREINNYHHAHDAYLNAVVGTALIKKYP  1002
S2  933 ETRQTKHVAQILDARFNTEHDENDKVIRDVKVITLKSNLVSQFRKDFEFYKVREINDYHHAHDAYLNAVVGTALLKKYP  1012
S3  925 ETRQITKHVAQILDARYNTEVNEKDKKNRTVKIITLKSNLVSNFRKEFRLYKVREINDYHHAHDAYLNAVVAKAILKKYP  1004
S4  651 DTRYATRGLMNLLRSYFRVN-------NLDVKVKSINGGFTSFLRRKWKFKKERNKGYKHHAEDALIIA----------  712

S1 1003 KLESEFVYGDYKVYDVRKMIAKSEQ--EIGKATAKYFFYSNIMNFFKTEITLANGEIRKRPLIETNGETGEIVWDKG---  1077
S2 1013 KLASEFVYGEYKKKYDIRKFITNSSD-----KATAKYFFYSNLMNFFKTKVKYADGTVFERPIIETNAD-GEIAWNKQ---  1083
S3 1005 KLEPEFVYGEYQKYDLKRYISRSKDPKEVEKATEKYFFYSNLLNFFKEEVHYADGTIVKRENIEYSKDTGEIAWNKE---  1081
S4  713 --NADFIFKEWKKLDKAKKVMENQM----------------------FEEKQAESMPEIETEQEYKEIFITPHQIK  764
```

```
S1  1078  -----RDFATVRKVLSMPQVNIVKKTEVQT GGFSKESILPKRNSDKLIARKKD---WDPKKYGGFDSPTVAYSVLVVAKV  1149
S2  1084  -----IDFEKVRKVLSYPQVNIVKKVETQT GGFSKESILPKGDSDKLIPRKTKKVYWDTKKYGGFDSPTVAYSVFVVADV  1158
S3  1082  -----KDFAIIKKVLSLPQVNIVKKREVQT GGFSKESILPKGNSDKLIPRKTKDILLDTTKYGGFDSPVIAYSILLIADI  1156
S4   765  HIKDFKDYKYSHRVDKKPNRELINDTLYST RKDDKGNTLIVNNLNGLYDKDNDKL----KKLIN-KSP----EKLLMYHH   835

S1  1150  EKGKSKKLKSVKELLGITIMERSSFEKNPI-DPLEAKG-----YKEVKKDLIIKLPKYSLFELENGRKRMLASAGELQKG  1223
S2  1159  EKGKAKKLKTVKELVGISIMERSFFEENPV-EFLENKG-----YHNIREDKLIKLPKYSLFEFEGGRRRLLASASELQKK  1232
S3  1157  EKGKAKKLKTVKTLVGITIMEKAAFEENPI-TFLENKG-----YHNVRKENILCLPKYSLFELENGRRRLLASAKELQKG  1230
S4   836  DPQTYQKLK--------LIMEQYGDEKNPLYKYYEETGNYLTKYSKKDNGPVIKKIKYYGNKLNAHLDITDDYPNSRNKV   907

S1  1224  NELALPSKYVNFLYLASHYEKLKGSPEDNEQKQLFVEQHKHYLDEIIEQISEFSKRVILADANLDKVLSAYNKH------  1297
S2  1233  NEMVLPGYLVELLYHAHRADNF-----NSTEYLNYVSEHKKEFEKVLSCVEDFANLYVDVEKNLSKIRAVADSM------  1301
S3  1231  NEIVLPVYLTTLLYHSKNVHKL-----DEPGHLEYIQKHRNEFKDLLNLVSEFSQKYVLADANLEKIKSLYADN------  1299
S4   908  VKLSLKPYRFD-VYLDNGVYKFV-----TVKNLDVIK--KENYYEVNSKAYEEAKKLKKISNQAEFIASFYNNDLIKING   979

S1  1298  RDKPIREQAENIIHLFTLTNLGAPAAFKYFDTTIDRKRYTSTKEVLDATLIHQSIT--------GLYETRI----DLSQL  1365
S2  1302  DNFSIEEISNSFINLLTLTALGAPADFNFLGEKIPRKRYTSTKECLNATLIHQSIT--------GLYETRI----DLSKL  1369
S3  1300  EQADIEILANSFINLLTFTALGAPAAFKFFGKDIDRKRYTTVSEILNATLIHQSIT--------GLYETWI----DLSKL  1367
S4   980  ELYRVIGVNNDLLNRIEVNMIDITYR-EYLENMNDKRPPRIIKTIASKT---QSIKKYSTDILGNLYEVKSKKHPQIIKK  1055

S1  1366  GGD  1368
S2  1370  GEE  1372
S3  1368  GED  1370
S4  1056  G--  1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 108-111 (e.g., 51, S2, S3, and S4, respectively) are mutated as described herein. The residues D10 and H840 in Cas9 of SEQ ID NO: 52 that correspond to the residues identified in SEQ ID NOs: 108-111 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 52 herein, e.g., mutations of residues 10, and 840 in SEQ ID NO: 52, are referred to herein as "homologous" or "corresponding" mutations. For example, the mutations corresponding to the D10A mutation in SEQ ID NO: 52 or 51 (SEQ ID NO: 108) for the four aligned sequences above are D11A for S2, D10A for S3, and D13A for S4; the corresponding mutations for H840A in SEQ ID NO: 52 or 51 (SEQ ID NO: 108) are H850A for S2, H842A for S3, and H560A for S4.

A total of 250 Cas9 sequences (SEQ ID NOs: 108-357) from different species were aligned using the same algorithm and alignment parameters outlined above. Amino acid residues homologous to residues 10, and 840 of SEQ ID NO: 52 were identified in the same manner as outlined above. The alignments are provided below. The HNH domain (bold and underlined) and the RuvC domain (boxed) are identified for each of the four sequences. Single residues corresponding to amino acid residues 10, and 840 in SEQ ID NO: 52 are boxed in SEQ ID NO: 108 in the alignments, allowing for the identification of the corresponding amino acid residues in the aligned sequences.

| Accession | Description | | | SEQ ID NO |
|---|---|---|---|---|
| WP_010922251.1type | II CRISPR RNA-guided endonuclease | Cas9 | [Streptococcus pyogenes] | SEQ ID NO: 108 |
| WP_039695303.1type | II CRISPR RNA-guided endonuclease | Cas9 | [Streptococcus gallolyticus] | SEQ ID NO: 109 |
| WP_045635197.1type | II CRISPR RNA-guided endonuclease | Cas9 | [Streptococcus mitis] | SEQ ID NO: 110 |
| 5AXW_A | Cas9, Chain A, Crystal Structure | | [Staphylococcus Aureus] | SEQ ID NO: 111 |
| WP_009880683.1type | II CRISPR RNA-guided endonuclease | Cas9 | [Streptococcus pyogenes] | SEQ ID NO: 112 |
| WP_010922251.1type | II CRISPR RNA-guided endonuclease | Cas9 | [Streptococcus pyogenes] | SEQ ID NO: 113 |
| WP_011054416.1type | II CRISPR RNA-guided endonuclease | Cas9 | [Streptococcus pyogenes] | SEQ ID NO: 114 |
| WP_011284745.1type | II CRISPR RNA-guided endonuclease | Cas9 | [Streptococcus pyogenes] | SEQ ID NO: 115 |
| WP_011285506.1type | II CRISPR RNA-guided endonuclease | Cas9 | [Streptococcus pyogenes] | SEQ ID NO: 116 |
| WP_011527619.1type | II CRISPR RNA-guided endonuclease | Cas9 | [Streptococcus pyogenes] | SEQ ID NO: 117 |
| WP_012560673.1type | II CRISPR RNA-guided endonuclease | Cas9 | [Streptococcus pyogenes] | SEQ ID NO: 118 |
| WP_014407541.1type | II CRISPR RNA-guided endonuclease | Cas9 | [Streptococcus pyogenes] | SEQ ID NO: 119 |
| WP_020905136.1type | II CRISPR RNA-guided endonuclease | Cas9 | [Streptococcus pyogenes] | SEQ ID NO: 120 |
| WP_023080005.1type | II CRISPR RNA-guided endonuclease | Cas9 | [Streptococcus pyogenes] | SEQ ID NO: 121 |
| WP_023610282.1type | II CRISPR RNA-guided endonuclease | Cas9 | [Streptococcus pyogenes] | SEQ ID NO: 122 |
| WP_030125963.1type | II CRISPR RNA-guided endonuclease | Cas9 | [Streptococcus pyogenes] | SEQ ID NO: 123 |
| WP_030126706.1type | II CRISPR RNA-guided endonuclease | Cas9 | [Streptococcus pyogenes] | SEQ ID NO: 124 |
| WP_031488318.1type | II CRISPR RNA-guided endonuclease | Cas9 | [Streptococcus pyogenes] | SEQ ID NO: 125 |
| WP_032460140.1type | II CRISPR RNA-guided endonuclease | Cas9 | [Streptococcus pyogenes] | SEQ ID NO: 126 |
| WP_032461047.1type | II CRISPR RNA-guided endonuclease | Cas9 | [Streptococcus pyogenes] | SEQ ID NO: 127 |
| WP_032462016.1type | II CRISPR RNA-guided endonuclease | Cas9 | [Streptococcus pyogenes] | SEQ ID NO: 128 |
| WP_032462936.1type | II CRISPR RNA-guided endonuclease | Cas9 | [Streptococcus pyogenes] | SEQ ID NO: 129 |
| WP_032464890.1type | II CRISPR RNA-guided endonuclease | Cas9 | [Streptococcus pyogenes] | SEQ ID NO: 130 |
| WP_033888930.1type | II CRISPR RNA-guided endonuclease | Cas9 | [Streptococcus pyogenes] | SEQ ID NO: 131 |
| WP_038431314.1type | II CRISPR RNA-guided endonuclease | Cas9 | [Streptococcus pyogenes] | SEQ ID NO: 132 |
| WP_038432938.1type | II CRISPR RNA-guided endonuclease | Cas9 | [Streptococcus pyogenes] | SEQ ID NO: 133 |
| WP_038434062.1type | II CRISPR RNA-guided endonuclease | Cas9 | [Streptococcus pyogenes] | SEQ ID NO: 134 |
| BAQ51233.1 | CRISPR-associated protein, Csn1 family | | [Streptococcus pyogenes] | SEQ ID NO: 135 |
| KGE60162.1 | hypothetical protein MGAS2111_0903 | | [Streptococcus pyogenes MGAS2111] | SEQ ID NO: 136 |
| KGE60856.1 | CRISPR-associated endonuclease protein | | [Streptococcus pyogenes SS1447] | SEQ ID NO: 137 |
| WP_002989955.1 | II CRISPR RNA-guided endonuclease | Cas9 | | SEQ ID NO: 138 |
| MULTISPECIES: type | II CRISPR RNA-guided endonuclease | Cas9 | [Streptococcus] | SEQ ID NO: 139 |
| WP_003030002.1 | | | | |
| MULTISPECIES: type | II CRISPR RNA-guided endonuclease | Cas9 | [Streptococcus] | SEQ ID NO: 140 |
| WP_003065552.1 | | | | |
| MULTISPECIES: type | II CRISPR RNA-guided endonuclease | Cas9 | | |
| WP_001040076.1type | II CRISPR RNA-guided endonuclease | Cas9 | [Streptococcus agalactiae] | SEQ ID NO: 141 |
| WP_001040078.1type | II CRISPR RNA-guided endonuclease | Cas9 | [Streptococcus agalactiae] | SEQ ID NO: 142 |
| WP_001040080.1type | II CRISPR RNA-guided endonuclease | Cas9 | [Streptococcus agalactiae] | SEQ ID NO: 143 |
| WP_001040081.1type | II CRISPR RNA-guided endonuclease | Cas9 | [Streptococcus agalactiae] | SEQ ID NO: 144 |
| WP_001040083.1type | II CRISPR RNA-guided endonuclease | Cas9 | [Streptococcus agalactiae] | SEQ ID NO: 145 |
| WP_001040085.1type | II CRISPR RNA-guided endonuclease | Cas9 | [Streptococcus agalactiae] | SEQ ID NO: 146 |
| WP_001040087.1type | II CRISPR RNA-guided endonuclease | Cas9 | [Streptococcus agalactiae] | SEQ ID NO: 147 |
| WP_001040088.1type | II CRISPR RNA-guided endonuclease | Cas9 | [Streptococcus agalactiae] | SEQ ID NO: 148 |
| WP_001040089.1type | II CRISPR RNA-guided endonuclease | Cas9 | [Streptococcus agalactiae] | SEQ ID NO: 149 |
| WP_001040090.1type | II CRISPR RNA-guided endonuclease | Cas9 | [Streptococcus agalactiae] | SEQ ID NO: 150 |
| WP_001040091.1type | II CRISPR RNA-guided endonuclease | Cas9 | [Streptococcus agalactiae] | SEQ ID NO: 151 |
| WP_001040092.1type | II CRISPR RNA-guided endonuclease | Cas9 | [Streptococcus agalactiae] | SEQ ID NO: 152 |
| WP_001040094.1type | II CRISPR RNA-guided endonuclease | Cas9 | [Streptococcus agalactiae] | SEQ ID NO: 153 |
| WP_001040095.1type | II CRISPR RNA-guided endonuclease | Cas9 | [Streptococcus agalactiae] | SEQ ID NO: 154 |
| WP_001040096.1type | II CRISPR RNA-guided endonuclease | Cas9 | [Streptococcus agalactiae] | SEQ ID NO: 155 |
| WP_001040097.1type | II CRISPR RNA-guided endonuclease | Cas9 | [Streptococcus agalactiae] | SEQ ID NO: 156 |

| Accession | Description | | | SEQ ID NO |
|---|---|---|---|---|
| WP_001040098.1type | II CRISPR RNA-guided endonuclease | Cas9 | [Streptococcus agalactiae] | SEQ ID NO: 157 |
| WP_001040099.1type | II CRISPR RNA-guided endonuclease | Cas9 | [Streptococcus agalactiae] | SEQ ID NO: 158 |
| WP_001040100.1type | II CRISPR RNA-guided endonuclease | Cas9 | [Streptococcus agalactiae] | SEQ ID NO: 159 |
| WP_001040104.1type | II CRISPR RNA-guided endonuclease | Cas9 | [Streptococcus agalactiae] | SEQ ID NO: 160 |
| WP_001040105.1type | II CRISPR RNA-guided endonuclease | Cas9 | [Streptococcus agalactiae] | SEQ ID NO: 161 |
| WP_001040106.1type | II CRISPR RNA-guided endonuclease | Cas9 | [Streptococcus agalactiae] | SEQ ID NO: 162 |
| WP_001040107.1type | II CRISPR RNA-guided endonuclease | Cas9 | [Streptococcus agalactiae] | SEQ ID NO: 163 |
| WP_001040108.1type | II CRISPR RNA-guided endonuclease | Cas9 | [Streptococcus agalactiae] | SEQ ID NO: 164 |
| WP_001040109.1type | II CRISPR RNA-guided endonuclease | Cas9 | [Streptococcus agalactiae] | SEQ ID NO: 165 |
| WP_001040110.1type | II CRISPR RNA-guided endonuclease | Cas9 | [Streptococcus agalactiae] | SEQ ID NO: 166 |
| WP_015058523.1type | II CRISPR RNA-guided endonuclease | Cas9 | [Streptococcus agalactiae] | SEQ ID NO: 167 |
| WP_017643650.1type | II CRISPR RNA-guided endonuclease | Cas9 | [Streptococcus agalactiae] | SEQ ID NO: 168 |
| WP_017647151.1type | II CRISPR RNA-guided endonuclease | Cas9 | [Streptococcus agalactiae] | SEQ ID NO: 169 |
| WP_017648376.1type | II CRISPR RNA-guided endonuclease | Cas9 | [Streptococcus agalactiae] | SEQ ID NO: 170 |
| WP_017649527.1type | II CRISPR RNA-guided endonuclease | Cas9 | [Streptococcus agalactiae] | SEQ ID NO: 171 |
| WP_017771611.1type | II CRISPR RNA-guided endonuclease | Cas9 | [Streptococcus agalactiae] | SEQ ID NO: 172 |
| WP_017771984.1type | II CRISPR RNA-guided endonuclease | Cas9 | [Streptococcus agalactiae] | SEQ ID NO: 173 |
| CFQ25032.1 | CRISPR-associated protein | | [Streptococcus agalactiae] | SEQ ID NO: 174 |
| CFV16040.1 | CRISPR-associated protein | | [Streptococcus agalactiae] | SEQ ID NO: 175 |
| KLJ37842.1 | CRISPR-associated protein Csn1 | | [Streptococcus agalactiae] | SEQ ID NO: 176 |
| KLJ72361.1 | CRISPR-associated protein Csn1 | | [Streptococcus agalactiae] | SEQ ID NO: 177 |
| KLL20707.1 | CRISPR-associated protein Csn1 | | [Streptococcus agalactiae] | SEQ ID NO: 178 |
| KLL42645.1 | CRISPR-associated protein Csn1 | | [Streptococcus agalactiae] | SEQ ID NO: 179 |
| WP_047207273.1type | II CRISPR RNA-guided endonuclease | Cas9 | [Streptococcus agalactiae] | SEQ ID NO: 180 |
| WP_047209694.1type | II CRISPR RNA-guided endonuclease | Cas9 | [Streptococcus agalactiae] | SEQ ID NO: 181 |
| WP_050198062.1type | II CRISPR RNA-guided endonuclease | Cas9 | [Streptococcus agalactiae] | SEQ ID NO: 182 |
| WP_050201642.1type | II CRISPR RNA-guided endonuclease | Cas9 | [Streptococcus agalactiae] | SEQ ID NO: 183 |
| WP_050204027.1type | II CRISPR RNA-guided endonuclease | Cas9 | [Streptococcus agalactiae] | SEQ ID NO: 184 |
| WP_050881965.1type | II CRISPR RNA-guided endonuclease | Cas9 | [Streptococcus agalactiae] | SEQ ID NO: 185 |
| WP_050886065.1type | II CRISPR RNA-guided endonuclease | Cas9 | [Streptococcus agalactiae] | SEQ ID NO: 186 |
| AHN30376.1 | CRISPR-associated protein Csn1 | | [Streptococcus agalactiae 138P] | SEQ ID NO: 187 |
| EA078426.1 | reticulocyte binding protein | | [Streptococcus agalactiae H36B] | SEQ ID NO: 188 |
| CCW42055.1 | CRISPR-associated protein, 5AG0894 family | | [Streptococcus agalactiae ILRI112] | SEQ ID NO:189 |
| WP_003041502.1type | II CRISPR RNA-guided endonuclease | Cas9 | [Streptococcus anginosus] | SEQ ID NO: 190 |
| WP_037593752.1type | II CRISPR RNA-guided endonuclease | Cas9 | [Streptococcus anginosus] | SEQ ID NO: 191 |
| WP_049516684.1 | CRISPR-associated protein Csn1 | | [Streptococcus anginosus] | SEQ ID NO: 192 |
| GAD46167.1 | hypothetical protein ANG6_0662 | | [Streptococcus anginosus T5] | SEQ ID NO: 193 |
| WP_018363470.1type | II CRISPR RNA-guided endonuclease | Cas9 | [Streptococcus caballi] | SEQ ID NO:194 |
| WP_003043819.1type | II CRISPR RNA-guided endonuclease | Cas9 | [Streptococcus canis] | SEQ ID NO: 195 |
| WP_006269658.1type | II CRISPR RNA-guided endonuclease | Cas9 | [Streptococcus constellatus] | SEQ ID NO: 196 |
| WP_048800089.1type | II CRISPR RNA-guided endonuclease | Cas9 | [Streptococcus constellatus] | SEQ ID NO: 197 |
| WP_012767106.1type | II CRISPR RNA-guided endonuclease | Cas9 | [Streptococcus dysgalactiae] | SEQ ID NO: 198 |
| WP_014612333.1type | II CRISPR RNA-guided endonuclease | Cas9 | [Streptococcus dysgalactiae] | SEQ ID NO: 199 |
| WP_015017095.1type | II CRISPR RNA-guided endonuclease | Cas9 | [Streptococcus dysgalactiae] | SEQ ID NO: 200 |
| WP_015057649.1type | II CRISPR RNA-guided endonuclease | Cas9 | [Streptococcus dysgalactiae] | SEQ ID NO: 201 |
| WP_048327215.1type | II CRISPR RNA-guided endonuclease | Cas9 | [Streptococcus dysgalactiae] | SEQ ID NO: 202 |
| WP_049519324.1 | CRISPR-associated protein Csn1 | | [Streptococcus dysgalactiae] | SEQ ID NO: 203 |
| WP_012515931.1type | II CRISPR RNA-guided endonuclease | Cas9 | [Streptococcus equi] | SEQ ID NO: 204 |
| WP_021320964.1type | II CRISPR RNA-guided endonuclease | Cas9 | [Streptococcus equi] | SEQ ID NO: 205 |
| WP_037581760.1type | II CRISPR RNA-guided endonuclease | Cas9 | [Streptococcus equi] | SEQ ID NO: 206 |
| WP_004232481.1type | II CRISPR RNA-guided endonuclease | Cas9 | [Streptococcus equinus] | SEQ ID NO: 207 |
| WP_009854540.1type | II CRISPR RNA-guided endonuclease | Cas9 | [Streptococcus gallolyticus] | SEQ ID NO: 208 |
| WP_012962174.1type | II CRISPR RNA-guided endonuclease | Cas9 | [Streptococcus gallolyticus] | SEQ ID NO: 209 |

| | | | | |
|---|---|---|---|---|
| WP_039695303.1type | II CRISPR RNA-guided endonuclease | Cas9 | [Streptococcus gallolyticus] | SEQ ID NO: 210 |
| WP_014334983.1type | II CRISPR RNA-guided endonuclease | Cas9 | [Streptococcus infantarius] | SEQ ID NO: 211 |
| WP_003099269.1type | II CRISPR RNA-guided endonuclease | Cas9 | [Streptococcus iniae] | SEQ ID NO: 212 |
| AHY15608.1 | CRISPR-associated protein Csn1 | | [Streptococcus iniae] | SEQ ID NO: 213 |
| AHY17476.1 | CRISPR-associated protein Csn1 | | [Streptococcus iniae] | SEQ ID NO: 214 |
| ESR09100.1 | hypothetical protein IUSA1_08595 | | [Streptococcus iniae IUSA1] | SEQ ID NO: 215 |
| AGM98575.1 | CRISPR-associated Cas9/Csn1, subtype II/NMEMI | | [Streptococcus iniae SF1] | SEQ ID NO: 216 |
| ALF27331.1 | CRISPR-associated protein Csn1 | | [Streptococcus intermedius] | SEQ ID NO: 217 |
| WP_018372492.1type | II CRISPR RNA-guided endonuclease | Cas9 | [Streptococcus massiliensis] | SEQ ID NO: 218 |
| WP_045618028.1type | II CRISPR RNA-guided endonuclease | Cas9 | [Streptococcus mitis] | SEQ ID NO: 219 |
| WP_045635197.1type | II CRISPR RNA-guided endonuclease | Cas9 | [Streptococcus mitis] | SEQ ID NO: 220 |
| WP_002263549.1type | II CRISPR RNA-guided endonuclease | Cas9 | [Streptococcus mutans] | SEQ ID NO: 221 |
| WP_002263887.1type | II CRISPR RNA-guided endonuclease | Cas9 | [Streptococcus mutans] | SEQ ID NO: 222 |
| WP_002264920.1type | II CRISPR RNA-guided endonuclease | Cas9 | [Streptococcus mutans] | SEQ ID NO: 223 |
| WP_002269043.1type | II CRISPR RNA-guided endonuclease | Cas9 | [Streptococcus mutans] | SEQ ID NO: 224 |
| WP_002269448.1type | II CRISPR RNA-guided endonuclease | Cas9 | [Streptococcus mutans] | SEQ ID NO: 225 |
| WP_002271977.1type | II CRISPR RNA-guided endonuclease | Cas9 | [Streptococcus mutans] | SEQ ID NO: 226 |
| WP_002272766.1type | II CRISPR RNA-guided endonuclease | Cas9 | [Streptococcus mutans] | SEQ ID NO: 227 |
| WP_002273241.1type | II CRISPR RNA-guided endonuclease | Cas9 | [Streptococcus mutans] | SEQ ID NO: 228 |
| WP_002275430.1type | II CRISPR RNA-guided endonuclease | Cas9 | [Streptococcus mutans] | SEQ ID NO: 229 |
| WP_002276448.1type | II CRISPR RNA-guided endonuclease | Cas9 | [Streptococcus mutans] | SEQ ID NO: 230 |
| WP_002277050.1type | II CRISPR RNA-guided endonuclease | Cas9 | [Streptococcus mutans] | SEQ ID NO: 231 |
| WP_002277364.1type | II CRISPR RNA-guided endonuclease | Cas9 | [Streptococcus mutans] | SEQ ID NO: 232 |
| WP_002279025.1type | II CRISPR RNA-guided endonuclease | Cas9 | [Streptococcus mutans] | SEQ ID NO: 233 |
| WP_002279859.1type | II CRISPR RNA-guided endonuclease | Cas9 | [Streptococcus mutans] | SEQ ID NO: 234 |
| WP_002280230.1type | II CRISPR RNA-guided endonuclease | Cas9 | [Streptococcus mutans] | SEQ ID NO: 235 |
| WP_002281696.1type | II CRISPR RNA-guided endonuclease | Cas9 | [Streptococcus mutans] | SEQ ID NO: 236 |
| WP_002282247.1type | II CRISPR RNA-guided endonuclease | Cas9 | [Streptococcus mutans] | SEQ ID NO: 237 |
| WP_002282906.1type | II CRISPR RNA-guided endonuclease | Cas9 | [Streptococcus mutans] | SEQ ID NO: 238 |
| WP_002283846.1type | II CRISPR RNA-guided endonuclease | Cas9 | [Streptococcus mutans] | SEQ ID NO: 239 |
| WP_002287255.1type | II CRISPR RNA-guided endonuclease | Cas9 | [Streptococcus mutans] | SEQ ID NO: 240 |
| WP_002288990.1type | II CRISPR RNA-guided endonuclease | Cas9 | [Streptococcus mutans] | SEQ ID NO: 241 |
| WP_002289641.1type | II CRISPR RNA-guided endonuclease | Cas9 | [Streptococcus mutans] | SEQ ID NO: 242 |
| WP_002290427.1type | II CRISPR RNA-guided endonuclease | Cas9 | [Streptococcus mutans] | SEQ ID NO: 243 |
| WP_002295753.1type | II CRISPR RNA-guided endonuclease | Cas9 | [Streptococcus mutans] | SEQ ID NO: 244 |
| WP_002296423.1type | II CRISPR RNA-guided endonuclease | Cas9 | [Streptococcus mutans] | SEQ ID NO: 245 |
| WP_002304487.1type | II CRISPR RNA-guided endonuclease | Cas9 | [Streptococcus mutans] | SEQ ID NO: 246 |
| WP_002305844.1type | II CRISPR RNA-guided endonuclease | Cas9 | [Streptococcus mutans] | SEQ ID NO: 247 |
| WP_002307203.1type | II CRISPR RNA-guided endonuclease | Cas9 | [Streptococcus mutans] | SEQ ID NO: 248 |
| WP_002310390.1type | II CRISPR RNA-guided endonuclease | Cas9 | [Streptococcus mutans] | SEQ ID NO: 249 |
| WP_002352408.1type | II CRISPR RNA-guided endonuclease | Cas9 | [Streptococcus mutans] | SEQ ID NO: 250 |
| WP_012997688.1type | II CRISPR RNA-guided endonuclease | Cas9 | [Streptococcus mutans] | SEQ ID NO: 251 |
| WP_0146777909.1type | II CRISPR RNA-guided endonuclease | Cas9 | [Streptococcus mutans] | SEQ ID NO: 252 |
| WP_019312892.1type | II CRISPR RNA-guided endonuclease | Cas9 | [Streptococcus mutans] | SEQ ID NO: 253 |
| WP_019313659.1type | II CRISPR RNA-guided endonuclease | Cas9 | [Streptococcus mutans] | SEQ ID NO: 254 |
| WP_019314093.1type | II CRISPR RNA-guided endonuclease | Cas9 | [Streptococcus mutans] | SEQ ID NO: 255 |
| WP_019315370.1type | II CRISPR RNA-guided endonuclease | Cas9 | [Streptococcus mutans] | SEQ ID NO: 256 |
| WP_019803776.1type | II CRISPR RNA-guided endonuclease | Cas9 | [Streptococcus mutans] | SEQ ID NO: 257 |
| WP_019805234.1type | II CRISPR RNA-guided endonuclease | Cas9 | [Streptococcus mutans] | SEQ ID NO: 258 |
| WP_024783594.1type | II CRISPR RNA-guided endonuclease | Cas9 | [Streptococcus mutans] | SEQ ID NO: 259 |
| WP_024784288.1type | II CRISPR RNA-guided endonuclease | Cas9 | [Streptococcus mutans] | SEQ ID NO: 260 |
| WP_024784666.1type | II CRISPR RNA-guided endonuclease | Cas9 | [Streptococcus mutans] | SEQ ID NO: 261 |

| Accession | Description | Organism | SEQ ID |
|---|---|---|---|
| WP_024784894.1 | type II CRISPR RNA-guided endonuclease | [Streptococcus mutans] | SEQ ID NO: 262 |
| WP_024786433.1 | type II CRISPR RNA-guided endonuclease | [Streptococcus mutans] | SEQ ID NO: 263 |
| WP_049473442.1 | CRISPR-associated protein Csn1 | [Streptococcus mutans] | SEQ ID NO: 264 |
| WP_049474547.1 | CRISPR-associated protein Csn1 | [Streptococcus mutans NLML4] | SEQ ID NO: 265 |
| EMC03581.1 | hypothetical protein SMU69_09359 | | SEQ ID NO: 266 |
| WP_000428612.1 | type II CRISPR RNA-guided endonuclease | [Streptococcus oralis] | SEQ ID NO: 267 |
| WP_000428613.1 | type II CRISPR RNA-guided endonuclease | [Streptococcus oralis] | SEQ ID NO: 268 |
| WP_049523028.1 | CRISPR-associated protein Csn1 | [Streptococcus parasanguinis] | SEQ ID NO: 269 |
| WP_003107102.1 | type II CRISPR RNA-guided endonuclease | [Streptococcus parauberis] | SEQ ID NO: 270 |
| WP_054279288.1 | type II CRISPR RNA-guided endonuclease | [Streptococcus phocae] | SEQ ID NO: 271 |
| WP_049531101.1 | CRISPR-associated protein Csn1 | [Streptococcus pseudopneumoniae] | SEQ ID NO: 272 |
| WP_049538452.1 | CRISPR-associated protein Csn1 | [Streptococcus pseudopneumoniae] | SEQ ID NO: 273 |
| WP_049549711.1 | CRISPR-associated protein Csn1 | [Streptococcus pseudopneumoniae] | SEQ ID NO: 274 |
| WP_007896501.1 | type II CRISPR RNA-guided endonuclease | [Streptococcus pseudoporcinus] | SEQ ID NO: 275 |
| EFR44625.1 | CRISPR-associated protein, Csn1 family | [Streptococcus pseudoporcinus SPIN 20026] | SEQ ID NO: 276 |
| WP_002897477.1 | type II CRISPR RNA-guided endonuclease | [Streptococcus sanguinis] | SEQ ID NO: 277 |
| WP_002906454.1 | type II CRISPR RNA-guided endonuclease | [Streptococcus sanguinis] | SEQ ID NO: 278 |
| WP_009729476.1 | type II CRISPR RNA-guided endonuclease | [Streptococcus sp. F0441] | SEQ ID NO: 279 |
| CQR24647.1 | CRISPR-associated protein | [Streptococcus sp. FF10] | SEQ ID NO: 280 |
| WP_000066813.1 | type II CRISPR RNA-guided endonuclease | [Streptococcus sp. M334] | SEQ ID NO: 281 |
| WP_009754323.1 | type II CRISPR RNA-guided endonuclease | [Streptococcus sp. taxon 056] | SEQ ID NO: 282 |
| WP_044674937.1 | type II CRISPR RNA-guided endonuclease | [Streptococcus suis] | SEQ ID NO: 283 |
| WP_044676715.1 | type II CRISPR RNA-guided endonuclease | [Streptococcus suis] | SEQ ID NO: 284 |
| WP_044680361.1 | type II CRISPR RNA-guided endonuclease | [Streptococcus suis] | SEQ ID NO: 285 |
| WP_044681799.1 | type II CRISPR RNA-guided endonuclease | [Streptococcus suis] | SEQ ID NO: 286 |
| WP_049533112.1 | CRISPR-associated protein Csn1 | [Streptococcus suis] | SEQ ID NO: 287 |
| WP_029090905.1 | type II CRISPR RNA-guided endonuclease | [Brochothrix thermosphacta] | SEQ ID NO: 288 |
| WP_050506696.1 | type II CRISPR RNA-guided endonuclease | [Catenibacterium mitsuokai] | SEQ ID NO: 289 |
| AIT42264.1 | Cas9hc:NLS:HA [Cloning vector pYB196] | | SEQ ID NO: 290 |
| WP_034440723.1 | type II CRISPR RNA-guided endonuclease | [Clostridiales bacterium S5-A11] | SEQ ID NO: 291 |
| AKQ21048.1 | Cas9 [CRISPR-mediated gene targeting vector p(bh5p68-Cas9)] | | SEQ ID NO: 292 |
| WP_004636532.1 | type II CRISPR RNA-guided endonuclease | [Dolosigranulum pigrum] | SEQ ID NO: 293 |
| WP_002364836.1 | type II CRISPR RNA-guided endonuclease | [Enterococcus] | SEQ ID NO: 294 |
| MULTISPECIES: type II CRISPR RNA-guided endonuclease | | | |
| MULTISPECIES: type II CRISPR RNA-guided endonuclease | | | |
| WP_016631044.1 | type II CRISPR RNA-guided endonuclease | [Enterococcus] | SEQ ID NO: 295 |
| EMS75795.1 | hypothetical protein H318_06676 | | SEQ ID NO: 296 |
| WP_002373311.1 | type II CRISPR RNA-guided endonuclease | [Enterococcus durans IPLA 655] | SEQ ID NO: 297 |
| WP_002378009.1 | type II CRISPR RNA-guided endonuclease | [Enterococcus faecalis] | SEQ ID NO: 298 |
| WP_002407324.1 | type II CRISPR RNA-guided endonuclease | [Enterococcus faecalis] | SEQ ID NO: 299 |
| WP_002413717.1 | type II CRISPR RNA-guided endonuclease | [Enterococcus faecalis] | SEQ ID NO: 300 |
| WP_010777580.1 | type II CRISPR RNA-guided endonuclease | [Enterococcus faecalis] | SEQ ID NO: 301 |
| WP_010818269.1 | type II CRISPR RNA-guided endonuclease | [Enterococcus faecalis] | SEQ ID NO: 302 |
| WP_010824395.1 | type II CRISPR RNA-guided endonuclease | [Enterococcus faecalis] | SEQ ID NO: 303 |
| WP_016622645.1 | type II CRISPR RNA-guided endonuclease | [Enterococcus faecalis] | SEQ ID NO: 304 |
| WP_033624816.1 | type II CRISPR RNA-guided endonuclease | [Enterococcus faecalis] | SEQ ID NO: 305 |
| WP_033625576.1 | type II CRISPR RNA-guided endonuclease | [Enterococcus faecalis] | SEQ ID NO: 306 |
| WP_033789179.1 | type II CRISPR RNA-guided endonuclease | [Enterococcus faecalis] | SEQ ID NO: 307 |
| WP_002310644.1 | type II CRISPR RNA-guided endonuclease | [Enterococcus faecium] | SEQ ID NO: 308 |
| WP_002312694.1 | type II CRISPR RNA-guided endonuclease | [Enterococcus faecium] | SEQ ID NO: 309 |
| WP_002314015.1 | type II CRISPR RNA-guided endonuclease | [Enterococcus faecium] | SEQ ID NO: 310 |
| WP_002320716.1 | type II CRISPR RNA-guided endonuclease | [Enterococcus faecium] | SEQ ID NO: 311 |

-continued

| | | | |
|---|---|---|---|
| WP_002330729.1type | II CRISPR RNA-guided endonuclease Cas9 | [Enterococcus faecium] | SEQ ID NO: 312 |
| WP_002335161.1type | II CRISPR RNA-guided endonuclease Cas9 | [Enterococcus faecium] | SEQ ID NO: 313 |
| WP_002345439.1type | II CRISPR RNA-guided endonuclease Cas9 | [Enterococcus faecium] | SEQ ID NO: 314 |
| WP_034867970.1type | II CRISPR RNA-guided endonuclease Cas9 | [Enterococcus faecium] | SEQ ID NO: 315 |
| WP_047937432.1type | II CRISPR RNA-guided endonuclease Cas9 | [Enterococcus faecium] | SEQ ID NO: 316 |
| WP_010720994.1type | II CRISPR RNA-guided endonuclease Cas9 | [Enterococcus hirae] | SEQ ID NO: 317 |
| WP_010737004.1type | II CRISPR RNA-guided endonuclease Cas9 | [Enterococcus hirae] | SEQ ID NO: 318 |
| WP_034700478.1type | II CRISPR RNA-guided endonuclease Cas9 | [Enterococcus hirae] | SEQ ID NO: 319 |
| WP_007209003.1type | II CRISPR RNA-guided endonuclease Cas9 | [Enterococcus italicus] | SEQ ID NO: 320 |
| WP_023511017.1type | II CRISPR RNA-guided endonuclease Cas9 | [Enterococcus mundtii] | SEQ ID NO: 321 |
| WP_010770040.1type | II CRISPR RNA-guided endonuclease Cas9 | [Enterococcus phoeniculicola] | SEQ ID NO: 322 |
| WP_048604708.1type | II CRISPR RNA-guided endonuclease Cas9 | [Enterococcus sp. AM1] | SEQ ID NO: 323 |
| WP_010750235.1type | II CRISPR RNA-guided endonuclease Cas9 | [Enterococcus villorum] | SEQ ID NO: 324 |
| AII16583.1 | Cas9 endonuclease [Expression vector pCas9] | | SEQ ID NO: 325 |
| WP_029073316.1type | II CRISPR RNA-guided endonuclease Cas9 | [Kandleria vitulina] | SEQ ID NO: 326 |
| WP_031589969.1type | II CRISPR RNA-guided endonuclease Cas9 | [Kandleria vitulina] | SEQ ID NO: 327 |
| KDA45870.1 | CRISPR-associated protein Cas9/Csn1, subtype II/NMEMI | | SEQ ID NO: 328 |
| WP_039099354.1type | II CRISPR RNA-guided endonuclease Cas9 | [Lactobacillus curvatus] | SEQ ID NO: 329 |
| AKP02966.1 | hypothetical protein ABB45_04605 | | SEQ ID NO: 330 |
| WP_010991369.1type | II CRISPR RNA-guided endonuclease Cas9 | [Listeria innocua] | SEQ ID NO: 331 |
| WP_033838504.1type | II CRISPR RNA-guided endonuclease Cas9 | [Listeria innocua ATCC 33091] | SEQ ID NO: 332 |
| EHN60060.1 | CRISPR-associated protein, Csn1 family | [Listeria innocua FSL 54-378] | SEQ ID NO: 333 |
| EFR89594.1 | crispr-associated protein, Csn1 family | [Listeria ivanovii] | SEQ ID NO: 334 |
| WP_038409211.1type | II CRISPR RNA-guided endonuclease Cas9 | [Listeria ivanovii FSL F6-596] | SEQ ID NO: 335 |
| EFR95520.1 | crispr-associated protein Csn1 | [Listeria monocytogenes] | SEQ ID NO: 336 |
| WP_003723650.1type | II CRISPR RNA-guided endonuclease Cas9 | [Listeria monocytogenes] | SEQ ID NO: 337 |
| WP_003727705.1type | II CRISPR RNA-guided endonuclease Cas9 | [Listeria monocytogenes] | SEQ ID NO: 338 |
| WP_003730785.1type | II CRISPR RNA-guided endonuclease Cas9 | [Listeria monocytogenes] | SEQ ID NO: 339 |
| WP_003733029.1type | II CRISPR RNA-guided endonuclease Cas9 | [Listeria monocytogenes] | SEQ ID NO: 340 |
| WP_003739838.1type | II CRISPR RNA-guided endonuclease Cas9 | [Listeria monocytogenes] | SEQ ID NO: 341 |
| WP_014601172.1type | II CRISPR RNA-guided endonuclease Cas9 | [Listeria monocytogenes] | SEQ ID NO: 342 |
| WP_023548323.1type | II CRISPR RNA-guided endonuclease Cas9 | [Listeria monocytogenes] | SEQ ID NO: 343 |
| WP_031665337.1type | II CRISPR RNA-guided endonuclease Cas9 | [Listeria monocytogenes] | SEQ ID NO: 344 |
| WP_031669209.1type | II CRISPR RNA-guided endonuclease Cas9 | [Listeria monocytogenes] | SEQ ID NO: 345 |
| WP_033920898.1type | II CRISPR RNA-guided endonuclease Cas9 | [Listeria monocytogenes FSL F2-208] | SEQ ID NO: 346 |
| AKI42028.1 | CRISPR-associated protein | [Listeria monocytogenes] | SEQ ID NO: 347 |
| AKI50529.1 | CRISPR-associated protein Csn1 | [Listeria monocytogenes] | SEQ ID NO: 348 |
| EFR83390.1 | crispr-associated protein Csn1 | [Listeria seeligeri] | SEQ ID NO: 349 |
| WP_046323366.1type | II CRISPR RNA-guided endonuclease Cas9 | [Plant multiplex genome editing vector pYLCRISPR/Cas9Pubi-H] | SEQ ID NO: 350 |
| AKE81011.1 | Cas9 | | SEQ ID NO: 351 |
| CUO82355.1 | Uncharacterized protein conserved in bacteria | [Roseburia hominis] | SEQ ID NO: 352 |
| WP_033162887.1type | II CRISPR RNA-guided endonuclease Cas9 | [Sharpea azabuensis] | SEQ ID NO: 353 |
| AGZ01981.1 | Cas9 endonuclease [synthetic construct] | | SEQ ID NO: 354 |
| AKA60242.1 | nuclease deficient Cas9 [synthetic construct] | | SEQ ID NO: 355 |
| AKS40380.1 | Cas9 [Synthetic plasmid pFC330] | | SEQ ID NO: 356 |
| 4UN5_B | Cas9, Chain B, Crystal Structure | | SEQ ID NO: 357 |

| | | |
|---|---|---|
| WP_010922251 | 1 | MDKK-YSIGL[D]IGTNSVGWAVITDEYKVPSKKFKVLGNTDRHSIKKNLIGALLFDSGETA--EATRLKRTARRRYT | 73 |

```
WP_039695303    1  MTKKnYSIGLDIGTNSVGWAVITDDYKVPAKKMKVLGNTDKKYIKKNLLGALLFDSGETA--EATRLKRTARRRYT  74
WP_045635197    1  K-KG-YSIGLDIGTNSVGFAVITDDYKVPSKKMKVLGNTDKRPIKKNLIGALLFDEGTTA--EARRLKRTARRRYT  73
5AXW_A          1  MKRN-YILGLDIGITSVGYGII--DYET------RDVIDA---GVRLFKEANVEnnEGRRSKRGARRLKR        61
WP_009880683    1  ----------------------------------------------------------------------     
WP_010922251    1  MDKK-YSIGLDIGTNSVGWAVITDEYKVPSKKFKVLGNTDRHSIKKNLIGALLFDSGETA--EATRLKRTARRRYT  73
WP_011054416    1  MDKK-YSIGLDIGTNSVGWAVITDDYKVPSKKLKGLGNTDRHGIKKNLIGALLFDSGETA--EATRLKRTARRRYT  73
WP_011284745    1  MDKK-YSIGLDIGTNSVGWAVITDDYKVPSKKFKVLGNTDRHSIKKNLIGALLFDSGETA--EATRLKRTARRRYT  73
WP_011285506    1  MDKK-YSIGLDIGTNSVGWAVITDDYKVPSKKFKVLGNTDRHSIKKNLIGALLFDSGETA--EATRLKRTARRRYT  73
WP_011527619    1  MDKK-YSIGLDIGTNSVGWAVITDDYKVPSKKFKVLGNTDRHSIKKNLIGALLFDSGEIA--EATRLKRTARRRYT  73
WP_012560673    1  MDKK-YSIGLDIGTNSVGWAVITDDYKVPSKKFKVLGNTDRHSIKKNLIGALLFDSGETA--EATRLKRTARRRYT  73
WP_014407541    1  MDKK-YSIGLDIGTNSVGWAVITDDYKVPSKKFKVLGNTDRHSIKKNLIGALLFGSGETA--EATRLKRTARRRYT  73
WP_020905136    1  MDKK-YSIGLDIGTNSVGWAVITDDYKVPSKKFKVLGNTDRHSIKKNLIGALLFDSGETA--EATRLKRTARRRYT  73
WP_023080005    1  MDKK-YSIGLDIGTNSVGWAVITDDYKVPSKKLKLVLGNTDRHGIKKNLIGALLFDSGETA--EATRLKRTARRRYT 73
WP_023610282    1  MDKK-YSIGLDIGTNSVGWAVITDDYKVPSKKLKVLGNTDRHGIKKNLIGALLFDSGETA--EATRLKRTARRRYT  73
WP_030125963    1  MDKK-YSIGLDIGTNSVGWAVITDDYKVPSKKFKVLGNTDRHGIKKNLIGALLFDSGETA--EATRLKRTARRRYT  73
WP_030126706    1  MDKK-YSIGLDIGTNSVGWAVITDDYKVPSKKFKVLGNTDRHSIKKNLIGALLFDSGETA--EATRLKRTARRRYT  73
WP_031488318    1  MDKK-YSIGLDIGTNSVGWAVITDDYKVPSKKFKVLGNTDRHSIKKNLIGALLFDSGETA--EATRLKRTARRRYT  73
WP_032460140    1  MDKK-YSIGLDIGTNSVGWAVITDDYKVPSKKFKVLGNTDRHSIKKNLIGALLFDSGETA--EATRLKRTARRRYT  73
WP_032461047    1  MDKK-YSIGLDIGTNSVGWAVITDDYKVPSKKFKVLGNTDRHSIKKNLIGALLFDSGETA--EATRLKRTARRRYT  73
WP_032462016    1  MDKK-YSIGLDIGTNSVGWAVITDDYKVPSKKFKVLGNTDRHSIKKNLIGALLFDSGETA--EATRLKRTARRRYT  73
WP_032462936    1  MDKK-YSIGLDIGTNSVGWAVITDDYKVPSKKFKVLGNTDRHSIKKNLIGALLFDSGETA--EATRLKRTARRRYT  73
WP_032464890    1  MDKK-YSIGLDIGTNSVGWAVITDDYKVPSKKFKVLGNTDRHSIKKNLIGALLFDSGETA--EATRLKRTARRRYT  73
WP_033888930    1  ----------------------------------------------------------------------     
WP_038431314    1  MDKK-YSIGLDIGTNSVGWAVITDDYKVPSKKFKVLGNTDRHSIKKNLIGALLFDSGETA--EATRLKRTARRRYT  73
WP_038432938    1  MDKK-YSIGLDIGTNSVGWAVITDDYKVPSKKFKVLGNTDRHSIKKNLIGALLFDSGETA--EATRLKRTARRRYT  73
WP_038434062    1  MDKK-YSIGLDIGTNSVGWAVITDDYKVPSKKFKVLGNTDRHSIKKNLIGALLFDSGETA--EATRLKRTARRRYT  73
BAQ51233        1  ----------------------------------------------------------------------     
KGE60162        1  ----------------------------------------------------------------------     
KGE60856        1  ----------------------------------------------------------------------     
WP_002989955    1  MDKK-YSIGLDIGTNSVGWAVITDDYKVPSKKFKVLGNTDRHSIKKNLIGALLFDSGETA--EATRLKRTARRRYT  73
WP_003030002    1  MDQK-YSIGLDIGTNSVGWAVVITDDYKVPAKKMKVLGNTDKQSIKKNLLGALLFDSGETA--EATRLKRTARRRYT 74
WP_003065552    1  MTKKnYSIGLDIGTNSVGWAVITDDYKVPSKKFKVLGNTDKKYIKKNLLGALLFDSGETA--EATRLKRTARRRYT  73
WP_001040076    1  MNKP-YSIGLDIGTNSVGWSIITDDYKVPAKKIRVLGNTDKEYIKKNLIGALLFDGGNTA--ADRRLKRTARRRYT  73
WP_001040078    1  MNKP-YSIGLDIGTNSVGWSIITDDYKVPAKKMRVLGNTDKEYIKKNLIGALLFDGGNTA--ADRRLKRTARRRYT  73
WP_001040080    1  MNKP-YSIGLDIGTNSVGWSIITDDYKVPAKKMRVLGNTDKEYIKKNLIGALLFDGGNTA--ADRRLKRTARRRYT  73
WP_001040081    1  MNKP-YSIGLDIGTNSVGWSIITDDYKVPAKKMRVLGNTDKEYIKKNLIGALLFDGGNTA--ADRRLKRTARRRYT  73
WP_001040083    1  MNKP-YSIGLDIGTNSVGWSIITDDYKVPAKKMRVLGNTDKEYIKKNLIGALLFDGGNTA--ADRRLKRTARRRYT  73
WP_001040085    1  MNKP-YSIGLDIGTNSVGWSIITDDYKVPAKKMRVLGNTDKEYIKKNLIGALLFDGGNTA--ADRRLKRTARRRYT  73
WP_001040087    1  MNKP-YSIGLDIGTNSVGWSIITDDYKVPAKKMRVLGNTDKEYIKKNLIGALLFDGGNTA--ADRRLKRTARRRYT  73
WP_001040088    1  MNKP-YSIGLDIGTNSVGWSIITDDYKVPAKKMRVLGNTDKEYIKKNLIGALLFDGGNTA--ADRRLKRTARRRYT  73
WP_001040089    1  MNKP-YSIGLDIGTNSVGWSIITDDYKVPAKKMRVLGNTDKEYIKKNLIGALLFDGGNTA--ADRRLKRTARRRYT  73
WP_001040090    1  MNKP-YSIGLDIGTNSVGWSIITDDYKVPAKKMRVLGNTDKEYIKKNLIGALLFDGGNTA--ADRRLKRTARRRYT  73
WP_001040091    1  MNKP-YSIGLDIGTNSVGWSIITDDYKVPAKKMRVLGNTDKEYIKKNLIGALLFDGGNTA--ADRRLKRTARRRYT  73
WP_001040092    1  MNKP-YSIGLDIGTNSVGWSIITDDYKVPAKKMRVLGNTDKEYIKKNLIGALLFDGGNTA--ADRRLKRTARRRYT  73
WP_001040094    1  MNKP-YSIGLDIGTNSVGWSIITDDYKVPAKKMRVLGNTDKEYIKKNLIGALLFDGGNTA--ADRRLKRTARRRYT  73
WP_001040095    1  MNKP-YSIGLDIGTNSVGWSIITDDYKVPAKKMRVLGNTDKEYIKKNLIGALLFDGGNTA--ADRRLKRTARRRYT  73
WP_001040096    1  MNKP-YSIGLDIGTNSVGWSIITDDYKVPAKKMRVLGNTDKEYIKKNLIGALLFDGGNTA--ADRRLKRTARRRYT  73
WP_001040097    1  MNKP-YSIGLDIGTNSVGWSIITDDYKVPAKKMRVLGNTDKEYIKKNLIGALLFDGGNTA--ADRRLKRTARRRYT  73
WP_001040098    1  MNKP-YSIGLDIGTNSVGWSIITDDYKVPAKKMRVLGNTDKEYIKKNLIGALLFDGGNTA--ADRRLKRTARRRYT  73
WP_001040099    1  MNKP-YSIGLDIGTNSVGWSIITDDYKVPAKKMRVLGNTDKEYIKKNLIGALLFDGGNTA--ADRRLKRTARRRYT  73
WP_001040100    1  MNKP-YSIGLDIGTNSVGWSIITDDYKVPAKKMRVLGNTDKEYIKKNLIGALLFDGGNTA--ADRRLKRTARRRYT  73
WP_001040104    1  MNKP-YSIGLDIGTNSVGWSIITDDYKVPAKKMRVLGNTDKEYIKKNLIGALLFDGGNTA--ADRRLKRTSRRRYT  73
WP_001040105    1  MNKP-YSIGLDIGTNSVGWSIITDDYKVPAKKMRVLGNTDKEYIKKNLIGALLFDGGNTA--ADRRLKRTARRRYT  73
```

```
-continued

WP_001040106    1  MNKP-YSIGLDIGTNSVGYSVVTDDYKVPAKKMRVLGNTDKEYIKKNLIGALLFDGGNTA--SDRRLKRTARRRYT  73
WP_001040107    1  MNKP-YSIGLDIGTNSVGYSVVTDDYKVPAKKMRVLGNTDKEYIKKNLIGALLFDGGNTA--SDRRLKRTARRRYT  73
WP_001040108    1  MNKP-YSIGLDIGTNSVGYSVVTDDYKVPAKKMRVLGNTDKEYIKKNLIGALLFDGGNTA--SDRRLKRTARRRYT  73
WP_001040109    1  MNKP-YSIGLDIGTNSVGYSVVTDDYKVPAKKMRVLGNTDKEYIKKNLIGALLFDGGNTA--SDRRLKRTARRRYT  73
WP_001040110    1  MNKP-YSIGLDIGTNSVGYSVVTDDYKVPAKKMRVLGNTDKEYIKKNLIGALLFDGGNTA--SDRRLKRTARRRYT  73
WP_015058523    1  MNKP-YSIGLDIGTNSVGYSVVTDDYKVPAKKMRVLGNTDKEYIKKNLIGALLFDGGNTA--ADRRLKRTARRRYT  73
WP_017643650    1  MNKP-YSIGLDIGTNSVGWSIITDDYKVPAKKMRVLGNTDKEYIKKNLIGALLFDGGNTA--ADRRLKRTARRRYT  73
WP_017647151    1  MNKP-YSIGLDIGTNSVGWSIITDDYKVPAKKMRVLGNTDKEYIKKNLIGALLFDGGNTA--ADRRLKRTARRRYT  73
WP_017648376    1  MNKP-YSIGLDIGTNSVGWSIITDDYKVPAKKMRVLGNTDKEYIKKNLIGALLFDGGNTA--SDRRLKRTARRRYT  73
WP_017649527    1  MNKP-YSIGLDIGTNSVGWSIITDDYKVPAKKMRVLGNTDKEYIKKNLIGALLFDGGNTA--ADRRLKRTARRRYT  73
WP_017771611    1  MNKP-YSIGLDIGTNSVGWSIITDDYKVPAKKMRVLGNTDKEYIKKNLIGALLFDGGNTA--ADRRLKRTARRRYT  73
WP_017771984    1  MNKP-YSIGLDIGTNSVGWSIITDDYKVPAKKMRVLGNTDKEYIKKNLIGALLFDGGNTA--ADRRLKRTARRRYT  73
CFQ25032        1  MNKP-YSIGLDIGTNSVGWSIITDDYKVPAKKMRVLGNTDKEYIKKNLIGALLFDGGNTA--ADRRLKRTARRRYT  73
CFV16040        1  MNKP-YSIGLDIGTNSVGWSIITDDYKVPAKKMRVLGNTDKEYIKKNLIGALLFDGGNTA--ADRRLKRTARRRYT  73
KLJ37842        1  MNKP-YSIGLDIGTNSVGWSIITDDYKVPAKKMRVLGNTDKEYIKKNLIGALLFDGGNTA--SDRRLKRTARRRYT  73
KLJ72361        1  MNKP-YSIGLDIGTNSVGWSIITDDYKVPAKKMRVLGNTDKEYIKKNLIGALLFDGRNTA--ADRRLKRTARRRYT  73
KLL20707        1  MNKP-YSIGLDIGTNSVGWSIITDDYKVPAKKMRVLGNTDKEYIKKNLIGALLFDGGNTA--ADRRLKRTARRRYT  73
KLL42645        1  MNKP-YSIGLDIGTNSVGYSVVTDDYKVPAKKMRVLGNTDKEYIKKNLIGALLFDGGNTA--SDRRLKRTARRRYT  73
WP_047207273    1  MNKP-YSIGLDIGTNSVGWSIITDDYKVPAKKMRVLGNTDKEYIKKNLIGALLFDGGNTA--ADRRLKRTARRRYT  73
WP_047209694    1  MNKP-YSIGLDIGTNSVGWSIITDDYKVPAKKMRVLGNTDKEYIKKNLIGALLFDGGNTA--ADRRLKRTARRRYT  73
WP_050198062    1  MNKP-YSIGLDIGTNSVGWSIITDDYKVPAKKMRVLGNTDKEYIKKNLIGALLEDGGNTA--ADRRLKRTARRRYT  73
WP_050201642    1  MNKP-YSIGLDIGTNSVGYSVVTDDYKVPAKKMRVLGNTDKEYIKKNLIGALLEDGGNTA--SDRRLKRTARRRYT  73
WP_050204027    1  MNKP-YSIGLDIGTNSVGWSIITDDYKVPAKKMRVLGNTDKEYIKKNLIGALLEDGGNTA--ADRRLKRTARRRYT  73
WP_050881965    1  MNKP-YSIGLDIGTNSVGWSIITDDYKVPAKKMRVLGNTDKEYIKKNLIGALLEDGGNTA--ADRRLKRTARRRYT  73
WP_050886065    1  MNKP-YSIGLDIGTNSVGWSIITDDYKVPAKKMRVLGNTDKEYIKKNLIGALLEDGGNTA--ADRRLKRIARRRYT  73
AHN30376        1  MNKP-YSIGLDIGXDIGTNSVGWSIITDDYKVPAKKMRVLGNTDKEYIKKNLIGALLEDGGNTA--ADRRLKRIARRRYT  73
EA078426        1  MNKP-YSIGLDIGTNSVGWSIITDDYKVPAKKMRVLGNTDKQSIKKNLLGALLGALLGALLEDGSETA--EATRLKRTARRRYT  73
CCW42055        1  MNQK-YSIGLDIGTNSVGWAVITDDYKVPAKKMKVLGNTDKQSIKKNLLGALLGALLEDSGETA--EATRLKRTARRRYT  74
WP_003041502    1  MKKE-YSIGLDIGTNSVGWAVITDDYKVPAKKMKVLGNTDKQSIKKNLLGALLFDSGETA--EATRLKRTARRRYT  74
WP_037593752    1  MKKE-YSIGLDIGTNSVGWAVITDDYKVPAKKMKVLGNTDKQSIKKNLLGALLFDSGETA--EATRLKRTARRRYT  74
WP_049516684    1  MTKKnYSIGLDIGTNSVGWAVITDDYKVPAKKMKVLGNTNRKSIKKNLMGALLGALLFDSGETA--EATRLKRTARRRYT  74
GAD46167        1  MTKKnYSIGLDIGTNSVGWAVITDDYKVPAKKMKVLGNTNRKSIKKNLMGALLGALLFDSGETA--EATRLKRTARRRYT  73
WP_018363470    1  MEKK-YSIGLDIGTNSVGWAVITDDYKVPAKKMKVLGNTDKQSIKKNLLGALLFDSGETA--EATRLKRTARRRYT  73
WP_003043819    1  MGKP-YSIGLDIGTNSVGWAVVTDDYKVPAKKMKVLGNTDKQSIKKNLLGALLFDSGETA--KATRLKRTARRRYT  73
WP_006269658    1  MTQK-YSIGLDIGTNSVGWAIVTDDYKVPAKKMKILGNTNKQYIKKNLLGALLFDSGETA--EATRLKRTARRRYT  73
WP_048800889    1  MDKK-YSIGLDIGTNSVGWAVITDDYKVPAKKMKVLGNTDRHSIKKNLLGALLFDSGETA--EATRLKRTARRRYT  73
WP_012767106    1  MDKK-YSIGLDIGTNSVGWAVITDDYKVPAKKMKVLGNTDRHSIKKNLLGALLFDSGETA--EATRLKRTARRRYT  73
WP_014612333    1  MDKK-YSIGLDIGTNSVGWAVITDDYKVPAKKMKVLGNTDRHSIKKNLLGALLFDSGETA--EATRLKRTARRRYT  73
WP_015017095    1  MDKK-YSIGLDIGTNSVGWAVITDDYKVPSKKFKVLGNTDRHSIKKNLLGALLFDSGETA--EATRLKRTARRRYT  73
WP_015057649    1  MDKK-YSIGLDIGTNSVGWAVITDDYKVPSKKFKVLGNTDRHSIKKNLLGALLFDSGETA--EATRLKRTARRRYT  73
WP_048327215    1  MDKK-YSIGLDIGTNSVGWAVITDDYKVPSKKFKVLGNTDRHSIKKNLLGALLFDSGETA--EATRLKRTARRRYT  73
WP_049519324    1  MKKP-YTIALDIGTNSVGWVVVTDDYRVPTKMKVLGNTERKTIKKNLIGALLFDSGETA--EGTRLKRTARPRYT  73
WP_012515931    1  MKKP-YTIALDIGTNSVGWVVVTDDYRVPTKMKVLGNTERKTIKKNLIGALLFDSGDTA--EGTRLKRTARPRYT  73
WP_021320964    1  MKKP-YTIALDIGTNSVGWVVVTDDYRVPTKMKVLGNTERKTIKKNLIGALLFDSGETA--EGTRLKRTARPRYT  74
WP_037581760    1  MKKP-YTIALDIGTNSVGWVVVTDDYRVPTKMKVLGNTERKTIKKNLIGALLFDSGDTA--EGTRLKRTARPRYT  74
WP_004232481    1  M-EKLYSIGLDIGTNSVGWAVITDDYKVPAKKMKVLGNTDRHSIKKNLLGALLFDSGETA--EATRLKRTARRRYT  73
WP_009854540    1  MTKKnYSIGLDIGTNSVGWAVITDDYKVPAKKMKVLGNTDKKYIKKNLLGALLFDSGETA--EATRLKRTARRRYT  73
WP_012962174    1  MTEKnYSIGLDIGTNSVGWAVITDDYKVPAKKMKVLGNTDKKYIKKNLLGALLFDSGETA--EATRLKRTARRRYT  73
WP_039695303    1  MTKKnYSIGLDIGTNSVGWAVITDDYKVPAKKMKVLGNTERKTIKKNLIGALLFDSGETA--EATRLKRTARRRYT  73
WP_014334983    1  M-EKsYSIGLDIGTNSVGWAVITDDYKVPSKKKNIQGTTDRTSIKKNLIGALLEDNGETA--EVTRLKRTARRRYT  73
WP_003099269    1  MRKP-YSIGLDIGTNSVGWAVITDDYKVPSKKKNIQGTTDRTSIKKNLIGALLEDNGETA--EATRLKRTTRRRYT  73
AHY15608        1  MRKP-YSIGLDIGTNSVGWAVITDDYKVPSKKKNIQGTTDRTSIKKNLIGALLEDNGETA--EATRLKRAARRRYT  74
AHY17476        1  MRKP-YSIGLDIGTNSVGWAVITDDYKVPSKKKNIQGTTDRTSIKKNLIGALLEDNGETA--EATRLKRTTRRRYT  73
```

-continued

```
ESR09100          1 ------------------------------------------------------------   0
AGM98575          1 MRKKP--YSIGLDIGTNSVGWAVITDDYKVPSKKMRIQGTTDRTSIKKNLIGALLEDNGHTA-EATRLKRTRRRYT  73
ALF27331          1 MKKKP--YSIGLDIGTNSVGWAVVTDDYKVPAKKMKVLGNTDKKSHIKKNLLGALLFDSGNTA-EDRRLKRTARRYT  73
WP_018372492      1 NNKP---YSIGLDIGTNSVGWAVVMEDYKVPSKKMKVLGNTDKKSHIKKNLLGALLEDSGHTAv-ERRLNRTTSRRYD  73
WP_045618028      1 MKKKP--YSIGLDIGTNSVGWAVITDDYKVPSKKMKVLGNTDKHFIKKNLLGALLFDEGTTA--EDRRLKRTARRRYT  74
WP_045635197      1 K-KG---YSIGLDIGTNSVGFAVITDDYKVPSKKMKVLGNTDKKRFIKKNLLGALLFDSGNTA--EARRLKRTARRYT  73
WP_002263549      1 MKKKP--YSIGLDIGTNSVGWAVVTDDYKVPAKKMKVLGNTDKKSHIKKNLLGALLFDSGNTA--EDRRLKRTARRYT  73
WP_002263887      1 MKKKP--YSIGLDIGTNSVGWAVVTDDYKVPAKKMKVLGNTDKKSHIKKNLLGALLFDSGNTA--EDRRLKRTARRYT  73
WP_002264920      1 MKKKP--YSIGLDIGTNSVGWAVVTDDYKVPAKKMKVLGNTDKKSHIKKNLLGALLFDSGNTA--EDRRLKRTARRYT  73
WP_002269043      1 MKKKP--YSIGLDIGTNSVGWAVVTDDYKVPAKKMKVLGNTDKKSHIKKNLLGALLFDSGNTA--EDRRLKRTARRYT  73
WP_002269448      1 MKKKP--YSIGLDIGTNSVGWAVVTDDYKVPAKKMKVLGNTDKKSHIKKNLLGALLFDSGNTA--EDRRLKRTARRYT  73
WP_002271977      1 MKKKP--YSIGLDIGTNSVGWAVVTDDYKVPAKKMKVLGNTDKKQSIKKNLLGALLEDSGETAv--ERRLNRTTSRRYD  73
WP_002272766      1 MKKKP--YSIGLDIGTNSVGWAVITDDYKVPSKKMKVLGNTDKHFIKKNLLGALLFDEGTTA--EDRRLKRTARRYT  74
WP_002273241      1 MKKKP--YSIGLDIGTNSVGWAVITDDYKVPSKKMKVLGNTDKKRFIKKNLLGALLFDSGNTA--EARRLKRTARRYT  73
WP_002275430      1 MKKKP--YSIGLDIGTNSVGWAVVTDDYKVPAKKMKVLGNTDKKSHIKKNLLGALLFDSGNTA--EDRRLKRTARRYT  73
WP_002276448      1 MKKKP--YSIGLDIGTNSVGWAVVTDDYKVPAKKMKVLGNTDKKSHIKKNLLGALLFDSGNTA--EDRRLKRTARRYT  73
WP_002277050      1 MKKKP--YSIGLDIGTNSVGWAVVTDDYKVPAKKMKVLGNTDKKSHIKKNLLGALLFDSGNTA--ADRRLKRTARRYT  73
WP_002277364      1 MKKKS--YSIGLDIGTNSVGWAVVTDDYKVPAKKMKVLGNTDKKSHIEKNLLGALLFDSGNTA--ADRRLKRTARRYT  73
WP_002273025      1 MKKKP--YSIGLDIGTNSVGWAVVTDDYKVPAKKMKVLGNTDKKSHIKKNLLGALLFDSGNTA--EDRRLKRTARRYT  73
WP_002279859      1 MKKKP--YSIGLDIGTNSVGWAVVTDDYKVPAKKMKVLGNTDKKSHIKKNLLGALLFDSGNTA--EDRRLKRTARRYT  73
WP_002280230      1 MKKKP--YSIGLDIGTNSVGWAVVTDDYKVPAKKMKVLGNTDKKSHIKKNLLGALLFDSGNTA--ADRRLKRTARRYT  73
WP_002281696      1 MKKKP--YSIGLDIGTNSVGWAVVTDDYKVPAKKMKVLGNTDKKSHIKKNLLGALLFDSGNTA--EDRRLKRTARRYT  73
WP_002282247      1 MKKKP--YSIGLDIGTNSVGWAVVTDDYKVPAKKMKVLGNTDKKSHIKKNLLGALLFDSGNTA--EDRRLKRTARRYT  73
WP_002282906      1 MKKKP--YSIGLDIGTNSVGWSVVTDDYKVPAKKMKVLGNTDKKSHIKKNLLGALLFDSGNTA--EDRRLKRTARRYT  73
WP_002283846      1 MKKKP--YSIGLDIGTNSVGWAVVTDDYKVPAKKMKVLGNTDKKSHIKKNLLGALLFDSGNTA--EDRRLKRTARRYT  73
WP_002287255      1 MKKKP--YSIGLDIGTNSVGWAVVTDDYKVPVSAKKMKVLGNTDKKSHIKKNLLGALLFDSGNTA--EDRRLKRTARRYT  73
WP_002288990      1 MKKKP--YSIGLDIGTNSVGWAVVTDDYKVPAKKMKVLGNTDKKSHIKKNLLGALLFDSGNTA--EDRRLKRTARRYT  73
WP_002289641      1 MKKKP--YSIGLDIGTNSVGWAVVTDDYKVPAKKMKVLGNTDKKSHIKKNLLGALLFDSGNTA--EDRRLKRTTRRRYT  73
WP_002290427      1 MKKKP--YSIGLDIGTNSVGWAVVTDDYKVPAKKMKVLGNTDKKSHIKKNLLGALLFDSGNTA--EDRRLKRTARRYT  73
WP_002295753      1 MKKKP--YSIGLDIGTNSVGWAVVTDDYKVPAKKMKVLGNTDKKSHIKKNLLGALLFDSGNTA--EDRRLKRTARRYT  73
WP_002296423      1 MKKKP--YSIGLDIGTNSVGWAVVTDDYKVPAKKMKVLGNTDKKSHIKKNLLGALLFDSGNTA--EDRRLKRTARRYT  73
WP_002304487      1 MKKKP--YSIGLDIGTNSVGWAVVTDDYKVPAKKMKVLGNTDKKSHIKKNLLGALLFDSGNTA--EDRRLKRTARRYT  73
WP_002305844      1 MKKKP--YSIGLDIGTNSVGWAVVTDDYKVPAKKMKVLGNTDKKSHIKKNLLGALLFDSGNTA--EDRRLKRTARRYT  73
WP_002307203      1 MKKKP--YSIGLDIGTNSVGWAVVTDDYKVPAKKMKVLGNTDKKSHIKKNLLGALLFDSGNTA--EDRRLKRTARRYT  73
WP_003310390      1 MKKKP--YSIGLDIGTNSVGWAVVTDDYKVPAKKMKVLGNTDKKSHIKKNLLGALLFDSGNTA--EDRRLKRTARRYT  73
WP_003352408      1 MKKKP--YSIGLDIGTNSVGWAVVTDDYKVPAKKMKVLGNTDKKSHIKKNLLGALLFDSGNTA--EDRRLKRTARRYT  73
WP_012997688      1 MKKKP--YSIGLDIGTNSVGWAVVTDDYKVPAKKMKVLGNTDKKSHIKKNLLGALLFDSGNTA--ADRRLKRTARRYT  73
WP_014677909      1 MKKKP--YSIGLDIGTNSVGWAVVTDDYKVPDKKMKVLGNTDKKSHIKKNLLGALLFDSGNTA--EDRRLKRTARRYT  73
WP_019312892      1 MKKKP--YSIGLDIGTNSVGWAVVTDDYKVPAKKMKVLGNTDKKSHIKKNLLGALLFDSGNTA--EDRRLKRTARRYT  73
WP_019313659      1 MKKKP--YSIGLDIGTNSVGWAVVTDDYKVPAKKMKVLGNTDKKSHIEKNLLGALLFDSGNTA--ADRRLKRTARRYT  73
WP_019314093      1 MKKKP--YSIGLDIGTNSVGWAVVTDDYKVPAKKMKVLGNTDKKSHIKKNLLGALLFDSGNTA--EDRRLKRTARRYT  73
WP_019315370      1 MKKKP--YSIGLDIGTNSVGWAVVTDDYKVPAKKMKVLGNTDKKSHIKKNLLGALLFDSGNTA--EDRRLKRTARRYT  73
WP_019803776      1 MKKKP--YSIGLDIGTNSVGWAVVTDDYKVPAKKMKVLGNTDKKSHIKKNLLGALLFDSGNTA--EDRRLKRTARRYT  73
WP_019805234      1 MKKKP--YSIGLDIGTNSVGWAVVTDDYKVPAKKMKVLGNTDKKSHIKKNLLGALLFDSGNTA--EDRRLKRTARRYT  73
WP_024783594      1 MKKKP--YSIGLDIGTNSVGWAVVTDDYKVPAKKMKVLGNTDKKSHIKKNLLGALLFDSGNTA--EDRRLKRTARRYT  73
WP_024784288      1 MKKKP--YSIGLDIGTNSVGWAVVTDDYKVPAKKMKVLGNTDKKSHIKKNLLGALLFDSGNTA--ADRRLKRTARRYT  73
WP_024784666      1 MKKKP--YSIGLDIGTNSVGWAVVTDDYKVPAKKMKVLGNTDKKSHIKKNLLGALLFDSGNTA--ADRRLKRTARRYT  73
WP_024784894      1 MKKKP--YSIGLDIGTNSVGWAVVTDDYKVPAKKMKVLGNTDKKSHIKKNLLGALLFDSGNTA--EDRRLKRTARRYT  73
WP_024786433      1 MKKKP--YSIGLDIGTNSVGWAVVTDDYKVPAKKMKVLGNTDKKSHIKKNLLGALLFDSGNTA--ADRRLKRTARRYT  73
WP_049473442      1 MKKKP--YSIGLDIGTNSVGWAVVTDDYKVPAKKMKVLGNTDKKSHIKKNLLGALLFDSGNTA--EDRRLKRTTRRYT  73
WP_049474547      1 MKKKP--YSIGLDIGTNSVGWAVVTDDYKVPAKKMKVLGNTDKKSHIKKNLLGALLFDSGNTA--ADRRLKRTARRYT  73
EMC03581          1 MDL------IGTNSVGWAVVTDDYKVPAKKMKVLGNTDKKSHIKKNLLGALLFDEGTTA--EARRLKRTARRYT  66
WP_000428612      1 ENKN---YSIGLDIGTNSVGWAVITDDYKVPSKKMKVLGNTDKKRFIKKNLLGALLFDEGTTA--EARRLKRTARRYT  74
```

```
                -continued

WP_000428613   1 ENKN-YSIGLDIGTNSVGWSVITDDYKVPSKKMKVLGNTDKRFIKKNLIGALLFDEGTTA-EARRLKRTARRRYT  74
WP_049523028   1 K-KP-YSIGLDIGTNSVGWAVITDDYKVPAKKMKVLGNTNKESIKKNLIGALLFDAGNTA-ADRRLKRTARRRYT  73
WP_003107102   1 -----------------------------MKVLGNTDRQVKKNMIGTLLFDSGETA-EARRLKRTARRRYT      42
WP_054279288   1 -KKS-YSIGLDIGTNSVGWAVITDDYKVPSKKMVLGNTSRQSIKKNMIGALLFDEGPA-ASTRVKRTTRRRYT    75
WP_049531101   1 SNKP-YSIGLDIGTNSVGWAVITDDYKVPSKKMKVLGNTDKHFIKKNLIGALLFDEGTTA-EDRRLKRTARRRYT  74
WP_049538452   1 SNKP-YSIGLDIGTNSVGWVIITDDYKVPSKKMKVLGNTDKHFIKKNLIGALLFDEGTTA-EDRRLKRTARRRYT  74
WP049549711    1 SNKP-YSIGLDIGTNSVGWAVITDDYKVPSKKMTVLGNTDKHFIKKNLIGALLFDEGTTA-EDRRLKRTARRRYT  74
WP_007896501   1 --YS-YSIGLDIGTNSVGWAVINEDYKVPAKKMTVFGNTDRKTIKKNLLGTVLFDSGETA-QARRLKRTNRRRYT  74
EFR44625       1 -----------------------------MLGTVLFDSGETA-QARRLKRTNRRRYT                   27
WP_002897477   1 K-KP-YSIGLDIGTNSVGWAVVTDDYKVPAKKMRVFGDTDRSHIKKNLLGTLLFDDGNTA-ESRRLKRTARRRYT  73
WP_002906454   1 K-KP-YSIGLDIGTNSVGWAVITDDYKVPSKKMKVLGNTDKHFIKKNLIGALLFDEGTTA-EDRRLKRTSRRRYT  73
WP_009729476   1 ENKN-YSIGLDIGTNSVGWSVITDDYKVPSKKMKVLGNTDKHFIKKNLIGALLFDEGTTA-EARRLKRTARRRYT  74
CQR24647       1 MKKP-YSIGLDIGTNSVGWAVITDDYKVPAKKMKVLGNTDKEYIKKNLIGALLFDEGTTA-EATRMKRTARRRYT  73
WP_000066813   1 SNKS-YSIGLDIGTNSVGWAVITDDYKVPSKKMKVLGNTDKHFIKKNLIGALLFDEGTTA-EDRRLKRTARRRYT  74
WP_009754323   1 NNNN-YSIGLDIGTNSVGWAVITDDYKVPSKKMRVLGNTEKRYIKKNLIGALLFDEGTTA-ENRRLKRTARRRYT  74
WP_044674937   1 MKKK-YAIGIDIGTNSVGWAVITDDYKVPSKKMVFGNTEKRYIKKNLLGTLLFDEGNTA-ENRRLKRTARRRYT   73
WP_044676715   1 MKKK-YAIGIDIGTNSVGWSVITDDYKVPSKKMKVFGNTEKRYIKKNLLGTLLFDEGNTA-ENRRLKRTARRRYT  73
WP_044680361   1 MKKK-YAIGIDIGTNSVGWSVVTDDYKVPSKKMKVFGNTEKRYIKKNLLGTLLFDEGNTA-ENRRLKRTARRRYT  73
WP_044681799   1 MKKK-YAIGIDIGTNSVGWSVVTDDYKVPSKKMKVFGNTEKRYIKKNLLGTLLFDEGNTA-EATRLKRTARRRYT  73
WP_049533112   1 MDQK-YSIGLDIGTNSVGWAVVLGNTDKQSIKKNLLGALLFDSGETA-EATRLKRTARRRYT               73
WP_029090905   1 ----------------------------AERRGYRSTRRRLN                                  27
WP_006506696   1 I-VD-YCIGLDLGTGSVGWAVDMNHRLMKRN-----GKHLMGSRLFSNAETA-ANRRASRSIRRRYN          60
AIT42264       1 MDKK-YSIGLDIGTNSVGWAVITDEYKVPSKKFKVLGNTDRHSIKKNLIGALLFDSGETA-EATRLKRTARRRYT  73
WP_034440723   1 -MKN-YTIGLDIGTNSVGWAVIKDDLTIVRKKIKISGNTDKKEVKKQNLMGSFLFEQGDTA-QDTRVKRIARRRYE  72
AKQ21048       1 MDKK-YSIGLDIGTNSVGWAVITDEYKVPSKKFKVLGNTDRHSIKKNLIGALLFDSGETA-EATRLKRTARRRYT  73
WP_004636532   1 MQKN-YTIGLDIGTNSVGWAVMKDDYTLIRKRMKVLGNTDIKKIKKNFWGVRLFDEGETA-KETRLKRGTRRRYQ  73
WP_002364836   1 MKKD-YVIGLDIGTNSVGWAVMTEDYQLVKKKMPIYGNTEKKKIKKNFWGVRLFEEGHTA-EDRRLKRTARRRIS  73
WP_016631044   1 ----------------------------MRLFEEGHTA-EDRRLKRTARRRIS                       24
EMS75795       1 ----------------------------------------------------------                   
WP_002373311   1 MKKD-YVIGLDIGTNSVGWAVMTEDYQLVKKKMPIYGNTEKKKIKKNFWGVRLFEEGHTA-EDRRLKRTARRRIS  73
WP_002378009   1 MKKD-YVIGLDIGTNSVGWAVMTEDYQLVKKKMPIYGNTEKKKIKKNFWGVRLFEEGHTA-EDRRLKRTARRRIS  73
WP_002407324   1 MKKD-YVIGLDIGTNSVGWAVMTEDYQLVKKKMPIYGNTEKKKIKKNFWGVRLFEEGHTA-EDRRLKRTARRRIS  73
WP_002413717   1 MKKD-YVIGLDIGTNSVGWAVMTEDYQLVKKKMPIYGNTEKKKIKKNFWGVRLFEEGHTA-EDRRLKRTARRRIS  73
WP_010775580   1 MKKD-YVIGLDIGTNSVGWAVMTEDYQLVKKKMPIYGNTEKKKIKKNFWGVRLFEEGHTA-EDRRLKRTARRRIS  73
WP_010818269   1 MKKD-YVIGLDIGTNSVGWAVMTEDYQLVKKKMPIYGNTEKKKIKKNFWGVRLFEEGHTA-EDRRLKRTARRRIS  73
WP_010824395   1 MKKD-YVIGLDIGSNSVGWAVMTEDYQLVKKKMPIYGNTEKKKIKKNFWGVRLFEEGHTA-EDRRLKRTARRRIS  73
WP_016622645   1 MKKD-YVIGLDIGTNSVGWAVMTEDYQLVKKKMPIYGNTEKKKIKKNFWGVRLFEEGHTA-EDRRLKRTARRRIS  73
WP_033624816   1 MKKD-YVIGLDIGTNSVGWAVMTEDYQLVKKKMPIYGNTEKKKIKKNFWGVRLFEEGHTA-EDRRLKRTARRRIS  73
WP_033625576   1 MKKE-YTIGLDIGTNSVGWSVLTDDYRLVSKKNMKVAGNTEKSSTKKNFWGVRLFDEGQTA-EARSKRTARRRLA  73
WP_033789179   1 MKKE-YTIGLDIGTNSVGWSVLTDDYRLVSKKNMKVAGNTEKSSTKKNFWGVRLFDEGQTA-EARSKRTARRRLA  73
WP_002310644   1 MKKE-YTIGLDIGTNSVGWSVLTDDYRLIVSKKNMKVAGNTEKSSTKKNFWGVRLFDEGQTA-EARRSKRTARRRLA 73
WP_002112694   1 MKKE-YTIGLDIGTNSVGWSVLTDDYRLIVSKKNMKVAGNTEKSSTKKNFWGVRLFDEGQTA-EARRSKRTARRRLA 73
WP_002314015   1 MKKE-YTIGLDIGTNSVGWSVLTDDYRLIVSKKNMKVAGNTEKSSTKKNFWGVRLFDEGQTA-EARRSKRTARRRLA 73
WP_002320716   1 MKKE-YTIGLDIGTNSVGWSVLTDDYRLIVSKKNMKVAGNTEKSSTKKNFWGVRLFDEGQTA-EARSKRTARRRLA 73
WP_002330729   1 MKKE-YTIGLDIGTNSVGWSVLTDDYRLIVSKKNMKVAGNTEKSSTKKNFWGVRLFDEGQTA-EARSKRTARRRLA 73
WP_002335161   1 MKKE-YTIGLDIGTNSVGWSVLTDDYRLIVSKKNMKVAGNTEKSSTKKNFWGVRLFDEGQTA-EARSKRTARRRLA 73
WP_002345439   1 MKKE-YTIGLDIGTNSVGWAVLTDDYQLMKRKMSVHGNTEKKKIKKNFWGARLFDEGQTA-EFRRTKRTNRRRLA  73
WP_034867970   1 MTKD-YTIGLDIGTNSVGWAVLTDDYQLMKRKMSVHGNTEKKKIKKNFWGARLFDEGQTA-EARRSKRTARRRLA  73
WP_047937432   1 MTKE-YTIGLDIGTNSVGWSVLTDDYRLVSKKNMKVAGNTEKSSTKKNFWGVRLFDEGQTA-EARSKRTARRRLA  73
WP_010720994   1 MTKD-YTIGLDIGTNSVGWAVLTDDYQLMKRKMSVHGNTEKKKIKKNFWGARLFDEGQTA-EFRRTKRTNRRRLA  73
WP_010737004   1 MTKD-YTIGLDIGTNSVGWAVLTDDYQLMKRKMSVHGNTEKKKIKKNFWGARLFDEGQTA-EFRRTKRTNRRRLA  73
WP_034700478   1 MTKD-YTIGLDIGTNSVGYSVVTDDYKVSIKKMNVFGNTEKKKSIKQNFWGVRLFESGQTA-QEARMKRTSRRRIA 73
WP_007209003   1 MKND-YTIGLDIGTNSVGYSVVTDDYKVISKKMNVFGNTEKKKSIKQNFWGVRLFESGQTA-QEARMKRTSRRRIA 73
```

-continued

```
WP_023519017    1  MEKE-YTIGLDIGTNSVGWAVLTDDYRLVARKMSIQDSNRKKIKKNFWGARLFEEKGKTA-QFRRIKRTNRRRIA              73
WP_010770040    1  MKKE-YTIGLDIGTNSVGWAVLTENYDIVKKKMKVYGNTETKYLKKNLMGVRLFDEGETA-ADRRLKRTTRRRYS              73
WP_048604708    1  MGKE-YTIGLDIGTNSVGWAVLQEDLDLVRRRMKVYGNTEKNYLKKNFWGVDLFDEGMTA-KDTRLKRTTRRYF              73
WP_010750235    1  MNKA-YTIGLDIGTNSVGWAVTDDYRLMAKKMPVHSKMEKKKIKKNFWGARLFDEGQTA-BERRNKRATRRRLR              73
AII16583        1  ADKK-YSIGLDIGTNSVGWAVITDEYKVPSKKFKVLGNTDRHSIKKNLIGALLFDSGETA-EATRLKRTARRYT              112
WP_029073316    1  NNKI-YNIGLDIGDASVGWAVVDEHYNLLKRH------GKHMWGSRLFTQANTA-VERRSSRLFTQANTA-VERRSSRSTRRRYN   65
WP_031589969    1  NNKI-YNIGLDIGDASVGWAVVDEHYNLLKRH------GKHMWGSRLFTQANTA-VERRSSRSTRRRYN                   65
KDA45870        1  LKKD-YSIGLDIGTNSVGHAVVTDDYKVPTKKMVFGDTSKKTIKKNMLGVLLFNEGQTA-ADTRLKRGARRRYT              74
WP_039099354    1  MSRP-YNIGLDIGTSSIGWSVVDDQSKLVSVR------GKYGYGVRLYDEGQTA-AERRSFRTTRRLK                    61
AKP02966        1  KEQP-YNIGLDIGTGSVGWAVTNDNYDLLNIK------KKNLMGVRLFEGAQTA-KETRLNRSTRRRYR                   64
WP_010991369    1  MKKP-YTIGLDIGTNSVGWAVLTDQYDLVKRKMKIAGDSEKKQIKKNFWGVRLFDEGQTA-ADRRMARTARRIE               73
WP_033838504    1  MKKP-YTIGLDIGTNSVGWAVLTDQYDLVKRKMKIAGDSEKKQIKKNFWGVRLFDEGQTA-ADRRMARTARRIE               73
EHN60060        1  MKKP-YTIGLDIGTNSVGWAVLTDQYDLVKRKMKIAGDSEKKQIKKNFWGVRLFDEGQTA-ADRRMARTARRIE               76
WP_038409211    1  MRKP-YTIGLDIGTNSVGWAVLTNQYDLVKRKMKVAGSAEKKQIKNFWGVRLFDEGEVA-AGRRMRTTRRRIE                73
EFR95520        1  -------------------------------------------------------------------------
WP_003723650    1  MKNP-YTIGLDIGTNSVGWAVLTDQYDLVKRKMKRMKVAGNSDKKQIKKNFWGVRLFDDGQTA-VDRRMNRTARRRIE           73
WP003727705     1  MKNP-YTIGLDIGTNSVGWAVLTDQYDLVKRKMKRMKVAGNSDKKQIKKNFWGVRLFDDGQTA-VDRRMNRTARRRIE           73
WP_003730785    1  MKNP-YTIGLDIGTNSVGWAVLTDQYDLVKRKMKRMKVAGNSDKKQIKKNFWGVRLFDDGQTA-VDRRMNRTARRRIE           73
WP_003733029    1  MKKP-YTIGLDIGTNSVGWAVLTDQYDLVKRKMKRMKIGDSEKKQIKKNFWGVRLFEKGETA-AKRRMSRTARRRIE            73
WP_003739838    1  MKNP-YTIGLDIGTNSVGWAVLTDQYDLVKRKMKRMKVAGNSDKKQIKKNFWGVRLFDDGQTA-ADRRMNRTARRRIE           73
WP_014601172    1  MKNP-YTIGLDIGTNSVGWAVLTDQYDLVKRKMKRMKVAGNSDKKQIKKNFWGVRLFDDGQTA-VDRRMNRTARRRIE           73
WP_023548323    1  MKNP-YTIGLDIGTNSVGWAVLTDQYDLVKRKMKRMKVAGNSDKKQIKKNFWGVRLFDDGQTA-VDRRMNRTARRRIE           73
WP_031665337    1  MKKP-YTIGLDIGTNSVGWAVLTDQYDLVKRKMKRMKIAGDSEKKQIKKNFWGVRLFDDGQTA-AKRRMSRTARRRIE           73
WP_031669209    1  MKNP-YTIGLDIGTNSVGWAVLTDQYDLVKRKMKRMKIGDSEKKQIKKNFWGVRLFEKGETA-VDRRMNRTARRRIE            76
WP_033920898    1  MKNP-YTIGLDIGTNSVGWAVLTDQYDLVKRKMKRMKVAGNSDKKQIKKNFWGVRLFDDGQTA-VDRRMNRTARRRIE           76
AKI42028        1  -------------------------------------------------------------------------
AKI50529        1  MKKP-YTIGLDIGTNSVGWAVLTDQYDLVKRKMKRMKVAGNSEKKQIKKNLMGVRLVDEGKTA-AHRVNRTTRRRIE            73
4UN5_B          1  ADKK-YSIGLDIGTNSVGWAVITDEYKVPSKKFKVLGNTDRHSIKKHLIGKHLMGSRLFSNAETA-ATRRSSRSIRRRYN         89
WP_046323366    1  I-VD-YCIGLDGTGSVGWAVVDMNHRLMKRN-------KKHLMGSRLFSNAETA-ATRRSSRSIRRRYN                   64
AKE81011        1  KDIR-YSIGLDIGTNSVGWAVMDEHYNLLKG-------NHMWGSRLFDAAEPA-ATRASRSIRRRYN                     65
CU082355        1  ADKK-YSIGLDIGTNSVGWAVITDEYKVPSKKFKVLGNTDRHSIKKNLIGALLFDSGETA-EATRLKRTARRYT               106
WP_033162887    1  MDKK-YSIGLAIGTNSVGWAVITDEYKVPSKKFKVLGNTDRHSIKKNLIGALLFDSGETA-EATRLKRTARRYT               73
AGZ01981        1  MDKK-YSIGLDIGTNSVGWAVITDEYKVPSKKFKVLGNTDRHSIKKNLIGALLFDSGETA-EATRLKRTARRYT               73
AKA60242        1  MDKK-YSIGLDIGTNSVGWAVITDEYKVPSKKFKVLGNTDRHSIKKNLIGALLFDSGETA-EATRLKRTARRYT               77
AKS40380        1

WP_010922251   74  RRKQNRICYLQEIFSNEMAKVDDSFFHRLEE-SFLVH-EEDKK---H  ERHPIPGNIV-DEVAYHEKPTIM LRKKLV        143

WP_039695303   75  RRKQNRLRYLQEIFANEIAKVDESFFQRLDE-SFLT--DDDKT---F                DSHPIPGNKA-EEDAYHQKPPTIYHLRKHLA 144
WP_045635197   74  RRKQNRLRYLQEIFSEEMSKVDSSFFHRLDD-SFLI--PEDKR---E                SKYPIPATLT-EEKEYHKQPPTIYHLRKQLA 143
5AXW_A         62  RRRHRIQRVKKLLFD-------YNLLTDhSELS--------G                     -NPYEARVK----------GLSQKLS     104
WP_099880683   74  RRKQNRICYLQEIFSNEMAKVDDSFFHRLEE-SFLV--EEDKK---H                ERHPIPGNIV-DEVAYHEKPTIYHLRKKLV 143
WP_010922251   74  RRKQNRICYLQEIFSNEMAKVDDSFFHRLEE-SFLV--EEDKK---H                ERHPIPGNIV-DEVAYHEKPTIYHLRKKLA 143
WP_011054416   74  RRKQNRICYLQEIFSNEMAKVDDSFFHRLEE-SFLV--EEDKK---H                ERHPIPGNIV-DEVAYHEKPTIYHLRKKLA 143
WP_011284745   74  RRKQNRICYLQEIFSNEMAKVDDSFFHRLEE-SFLV--EEDKK---H                ERHPIPGNIV-DEVAYHEKPTIYHLRKKLV 143
WP_011285506   74  RRKQNRICYLQEIFSNEMAKVDDSFFHRLEE-SFLV--EEDKK---H                ERHPIPGNIV-DEVAYHEKPTIYHLRKKLV 143
WP_011527619   74  RRKQNRICYLQEIFSNEMAKVDDSFFHRLEE-SFLV--EEDKK---H                ERHPIPGNIV-DEVAYHEKPTIYHLRKKLA 143
WP_012560673   74  RRKQNRICYLQEIFSNEIAKVDDSFFHRLEE-SFLV--EEDKK---H                ERHPIPGNIV-DEVAYHEKPTIYHLRKKLA 143
WP_014407541   74  RRKQNRICYLQEIFSNEMAKVDDSFFHRLEE-SFLV--EEDKK---H                ERHPIPGNIV-DEVAYHEKPTIYHLRKKLA 143
WP_020905136   74  RRKQNRICYLQEIFSNEMAKVDDSFFHRLEE-SFLV--EEDKK---H                ERHPIPGNIV-DEVAYHEKPTIYHLRKKLV 143
```

```
-continued

WP_023080005   74  RRKQNRICYLQEIFSNEMAKVDDSFFHRLEE-SFLV--EEDKK---H   ERHPIFGNIV-DEVAYHEKPTIYHLRKKLA   143
WP_023610282   74  RRKQNRICYLQEIFSNEMAKVDDSFFHRLEE-SFLV--EEDKK---H   ERHPIFGNIV-DEVAYHEKPTIYHLRKKLV   143
WP_030125963   74  RRKQNRICYLQEIFSNEMAKVDDSFFHRLEE-SFLV--EEDKK---H   ERHPIFGNIV-DEVAYHEKPTIYHLRKKLA   143
WP_030126706   74  RRKQNRICYLQEIFSNEMAKVDDSFFHRLEE-SFLV--EEDKK---H   ERHPIFGNIV-DEVAYHEKPTIYHLRKKLA   143
WP_031488318   74  RRKQNRICYLQEIFSNEMAKVDDSFFHRLEE-SFLV--EEDKK---H   ERHPIFGNIV-DEVAYHEKPTIYHLRKKLA   143
WP_032460140   74  RRKQNRICYLQEIFSNEIAKVDDSFFHRLEE-SFLV--EEDKK---H   ERHPIFGNIV-DEVAYHEKPTIYHLRKKLA   143
WP_032461047   74  RRKQNRICYLQEIFSNETAKVDDSFFHRLEE-SFLV--EEDKK---H   ERHPIFGNIV-DEVAYHEKPTIYHLRKKLA   143
WP_032462016   74  RRKQNRICYLQEIFSNEMAKVDDSFFHRLEE-SFLV--EEDKK---H   ERHPIFGNIV-DEVAYHEKPTIYHLRKKLA   143
WP_032462936   74  RRKQNRICYLQEIFSNEMAKVDDSFFHRLEE-SFLV--EEDKK---H   ERHPIFGNIV-DEVAYHEKPTIYHLRKKLA   143
WP_032464890   74  RRKQNRICYLQEIFSNEMAKVDDSFFHRLEE-SFLV--EEDKK---H   ERHPIFGNIV-DEVAYHEKPTIYHLRKKLV   143
WP_033888930   --  -----------------------------------------------   ------------------------------   --
WP_038431314   74  RRKQNRICYLQEIFSNEMAKVDDSFFHRLEE-SFLV--EEDKK---H   ERHPIFGNIV-DEVAYHEKPTIYHLRKKLA   143
WP_038432938   74  RRKQNRICYLQEIFSNEMAKVDDSFFHRLEE-SFLV--EEDKK---H   ERHPIFGNIV-DEVAYHEKPTIYHLRKKLA   143
WP_038434062   74  RRKQNRICYLQEIFSNEMAKVDDSFFHRLEE-SFLV--EEDKK---H   ERHPIFGNIV-DEVAYHEKPTIYHLRKKLV   143
BAQ51233        1  ------MAKVDDSFFHRLEE-SFLV--EEDKK---H               -----------------------------   54
KGE60162       --  -----------------------------------------------   ------------------------------   --
KGE60856       74  RRKQNRICYLQEIFSNEMAKVDDSFFHRLEE-SFLV--EEDKK---H   ERHPIFGNIV-DEVAYHEKPTIYHLRKKLV   143
WP_002989955   74  RRRNRLRLRYLQEIFAEEMNKVDDSFFHRLDD-SFLV--DEDKR---G   ERHPIFGNIA-AEVKYHDDFPTIYHLRKHLA   143
WP_003030002   75  RRKQNRLRYLQEIFAEEMKVDDSFFHRLEE-SFLV--EEDKR---G     GRYPIFGNKA-DVVKYHQEFPTIYHLRKHLA   146
WP_003065552   74  RRKQNRLRYLQEIFAEEMKVDDSFFHRLEE-SFLV--EEDKR---G     GRYPIFGNKA-DVVKYHQEFPTIYHLRKHLA   143
WP_001040076   74  RRRNRILYLQEIFAEEMSKVDDSFFHRLED-SFLV--EEDKR---G     SKYPIFATLQ-EEKDYHEKFPTIYHLRKELA   143
WP_001040078   74  RRRNRILYLQEIFAEEMSKVDDSFFHRLED-SFLV--EEDKR---G     SKYPIFATLQ-EEKDYHEKFPTIYHLRKELA   143
WP_001040080   74  RRRNRILYLQEIFAEEMSKVDDSFFHRLED-SFLV--EEDKR---G     SKYPIFATLQ-EEKDYHEKSTIYHLRKELA   143
WP_001040081   74  RRRNRILYLQEIFAEEMSKVDDSFFHRLED-SFLV--EEDKR---G     SKYPIFATLQ-EEKDYHEKSTIYHLRKELA   143
WP_001040083   74  RRRNRILYLQEIFAEEMSKVDDSFFHRLED-SFLV--EEDKR---G     SKYPIFATMQ-EEKYYHEKFPTIYHLRKELA   143
WP_001040085   74  RRRNRILYLQEIFAEEMSKVDDSFFHRLED-SFLV--EEDKR---G     SKYPIFATLQ-EEKDYHEKFPTIYHLRKELA   143
WP_001040087   74  RRRNRILYLQEIFAEEMSKVDDSFFHRLED-SFLV--EEDKR---G     SKYPIFATMQ-EEKYYHEKFPTIYHLRKELA   143
WP_001040088   74  RRRNRILYLQEIFAEEMSKVDDSFFHRLED-SFLV--EEDKR---G     SKYPIFATMQ-EEKYYHEKFPTIYHLRKELA   143
WP_001040089   74  RRRNRILYLQEIFAEEMSKVDDSFFHRLED-SFLV--EEDKR---G     SKYPIFATLQ-EEKDYHEKFPTIYHLRKELA   143
WP_001040090   74  RRRNRILYLQEIFAEEMSKVDDSFFHRLED-SFLV--EEDKR---G     SKYPIFATMQ-EEKYYHEKFPTIYHLRKELA   143
WP_001040091   74  RRRNRILYLQEIFAEEMSKVDDSFFHRLED-SFLV--EEDKR---G     SKYPIFATMQ-EEKYYHEKFPTIYHLRKELA   143
WP_001040092   74  RRRNRILYLQEIFAEEMSKVDDSFFHRLED-SFLV--EEDKR---G     SKYPIFATMQ-EEKYYHEKFPTIYHLRKELA   143
WP_001040094   74  RRRNRILYLQEIFAEEMSKVDDSFFHRLED-SFLV--EEDKR---G     SKYPIFATMQ-EEKYYHEKFPTIYHLRKELA   143
WP_001040095   74  RRRNRILYLQEIFAEEMSKVDDSFFHRLED-SFLV--EEDKR---G     SKYPIFATLQ-EEKDYHEKFPTIYHLRKELA   143
WP_001040096   74  RRRNRILYLQEIFAEEMSKVDDSFFHRLED-SFLV--EEDKR---G     SKYPIFATMQ-EEKYYHEKFPTIYHLRKELA   143
WP_001040097   74  RRRNRILYLQEIFAEEMSKVDDSFFHRLED-SFLV--EDDKR---G     SKYPIFATLQ-EEKDYHEKFPTIYHLRKELA   143
WP_001040098   74  RRRNRILYLQEIFAEEMSKVDDSFFHRLED-SFLV--EDDKR---G     SKYPIFATMQ-EEKYYHEKFPTIYHLRKELA   143
WP_001040099   74  RRRNRILYLQEIFAEEMSKVDDSFFHRLED-SFLV--EEDKR---G     SKYPIFATMQ-EEKYYHEKFPTIYHLRKELA   143
WP_001040100   74  RRRNRILYLQEIFAEEMSKVDDSFFHRLED-SFLV--EDDKR---G     SKYXIFATLQ-EEKDYHEKFPTIYHLRKELA   143
WP_001040104   74  CRRNRILYLQEIFAEEMSKVDDSFFHRLED-SFLV--EDDKR---G     SKYPIFATMQ-EEKYYHEKFPTIYHLRKELA   143
WP_001040105   74  RRRNRILYLQEIFAEEMSKVDDSFFHRLED-SFLV--EDDKR---G     SKYPIFATLQ-EEKDYHEKFPTIYHLRKELA   143
WP_001040106   74  RRRNRILYLQEIFAEEMSKVDDSFFHRLED-SFLV--EDDKR---G     SKYPIFATMQ-EEKYYHEKFPTIYHLRKELA   143
WP_001040107   74  RRRNRILYLQEIFAEEMSKVDDSFFHRLED-SFLV--EDDKR---G     SKYPIFATLQ-EEKDYHEKFPTIYHLRKELA   143
WP_001040108   74  RRRNRILYLQEIFAEEMSKVDDSFFHRLED-SFLV--EDDKR---G     SKYPIFATMQ-EEKYYHEKFPTIYHLRKELA   143
WP_001040109   74  RRRNRILYLQEIFAEEMSKVDDSFFHRLED-SFLV--EDDKR---G     SKYPIFATLQ-EEKDYHEKFPTIYHLRKELA   143
WP_001040110   74  RRRNRILYLQEIFAEEMSKVDDSFFHRLED-SFLV--EDDKR---G     SKYPIFATMQ-EEKYYHEKFPTIYHLRKELA   143
WP_015058523   74  RRRNRILYLQEIFAEEMSKVDDSFFHRLED-SFLV--EDDKR---G     SKYPIFATLQ-EEKDYHEKFPTIYHLRKELA   143
WP_017643650   74  RRRNRILYLQEIFAEEMSKVDDSFFHRLED-SFLV--EDDKR---G     SKYPIFATMQ-EEKYYHEKFPTIYHLRKELA   143
WP_017647151   74  RRRNRILYLQEIFAEEMSKVDDSFFHRLED-SFLV--EDDKR---G     SKYPIFATLQ-EEKDYHEKFPTIYHLRKELA   143
WP_017648376   74  RRRNRILYLQEIFAEEMSKVDDSFFHRLED-SFLV--EDDKR---G     SKYPIFATMQ-EEKYYHEKFPTIYHLRKELA   143
WP_017649527   74  RRRNRILYLQEIFAEEMSKVDDSFFHRLED-SFLV--EDDKR---G     SKYPIFATMQ-EEKYYHEKFPTIYHLRKELA   143
WP_017771611   74  RRRNRILYLQEIFAEEMSKVDDSFFHRLED-SFLV--EDDKR---G     SKYPIFATMQ-EEKYYHEKFPTIYHLRKELA   143
WP_017771984   74  RRRNRILYLQEIFAEEMSKVDDSFFHRLED-SFLV--EDDKR---G     SKYPIFATMQ-EEKDYHEKFPTIYHLRKELA   143
```

-continued

| | | | | |
|---|---|---|---|---|
| CFQ25032 | 74 | RRRNRILYLQEIFAEEMSKVDDSFFHRLED-SFLV-EEDKR----G | SKYPIFATLQ-EEKDYHEKFSTIYHLRKELA | 143 |
| CFV16040 | 74 | RRRNRILYLQEIFAEEMSKVDDSFFHRLED-SFLV-EEDKR----G | SKYPIFATLQ-EEKDYHEKFSTIYHLRKELA | 143 |
| KLJ37842 | 74 | RRRNRILYLQEIFAEEMSKVDDSFFHRLED-SFLV-EEDKR----G | SKYPIFATLQ-EEKDYHEKFSTIYHLRKELA | 143 |
| KLJ72361 | 74 | RRRNRILYLQEIFAEEMSKVDDSFFHRLED-SFLV-EEDKR----G | SKYPIFATLQ-EEKDYHEKFSTIYHLRKELA | 143 |
| KLL20707 | 74 | RRRNRILYLQEIFAEEMSKVDDSFFHRLED-SFLV-EDDKR----G | SKYPIFATLQ-EEKDYHEKPTIYHLRKELA | 143 |
| KLL42645 | 74 | RRRNRILYLQEIFAEEMSKVDDSFFHRLED-SFLV-EEDKR----G | SKYPIFATMQ-EEKDYHEKPTIYHLRKELA | 143 |
| WP_047207273 | 74 | RRRNRILYLQEIFAEEMSKVDDSFFHRLED-SFLV-EDDKR----G | SKYPIFATMQ-EEKDYHEKPTIYHLRKELA | 143 |
| WP_047209694 | 74 | RRRNRILYLQEIFAEEMSKVDDSFFHRLED-SFLV-EEDKR----G | SKYPIFATLQ-EEKDYHEKPTIYHLRKELA | 143 |
| WP_050198062 | 74 | RRRNRILYLQEIFAEEMSKVDDSFFHRLED-SFLV-EEDKR----G | SKYPIFATMQ-EEKDYHEKPTIYHLRKELA | 143 |
| WP_050201642 | 74 | RRRNRILYLQEIFAEEMSKVDDSFFHRLED-SFLV-EEDKR----G | SKYPIFATLQ-EEKDYHEKPTIYHLRKELA | 143 |
| WP_050204027 | 74 | RRRNRILYLQEIFAEEMSKVDDSFFHRLED-SFLV-EEDKR----G | SKYPIFATLQ-EEKDYHEKSTIYHLRKELA | 143 |
| WP_050881965 | 74 | RRRNRILYLQEIFAEEMSKVDDSFFHRLED-SFLV-EEDKR----G | SKYPIFATLQ-EEKDYHEKFSTIYHLRKELA | 143 |
| WP_050886065 | 74 | RRRNRILYLQEIFAEKMSKVDDSFFHRLED-SFLV-EEDKR----G | SKYPIFATLQ-EEKDYHEKFSTIYHLRKELA | 143 |
| AHN30376 | 74 | RRRNRILYLQEIFAEEMQVDESFFQRLDD-SFLV-DEDKR----G | ERHPIFGNIA-AEVKHDEFPTIYHLREELA | 143 |
| EA078426 | 74 | RRRNRLRYLQEIFAEEMNKVDENFFQRLDD-SFLV-EEDKQ----G | SKYPIFGTLK-EEKEYHKKFKTIYHLREELA | 143 |
| CCW42055 | 74 | RRRNRLRYLQEIFAEEMNKVDENFFQRLDD-SFLV-EEDKQ----G | SRYPIFGNIA-AEVKHDDPPTIYHLRKHLV | 144 |
| WP_003041502 | 75 | RRRNRLRYLQEIFAEEMNKVDENFFQRLDD-SFLV-EEDKQ----G | SKYPIFGTLK-EEKEYYKEFEFTIYHLRKHLV | 144 |
| WP_037593752 | 75 | RRRNRLRYLQEIFAEEMNKVDENFFQRLDD-SFLV-EEDKQ----G | SKYPIFGTLK-EEKEYHKFKFTIYHLRKHLA | 144 |
| WP_049516684 | 75 | RRRNRLRYLQEIFAEEMNKVDENFFQRLDD-SFLV-EEDKQ----G | DSHPIFGNKA-EEDAVHQKFPTIYHLRKHLA | 144 |
| GAD46167 | 75 | RRQNRLRYLQEIFAEEMNKVDENFFQRLDD-SFLV-EEDKQ----G | ERHPIFGNLA-DEVAYHRNYPTIYHLRKKLA | 143 |
| WP_018363470 | 74 | RRQNRLRYLQEIFANEMAKLDDSFFQRLEE-SFLV-EEDKR----N | EHHPIFGNIA-AEVKHDDDPPTIYHLRRHLA | 143 |
| WP_003043819 | 74 | RRQNRIRYLQEIFTGEMNKVDENFFQRLDD-SFLV-DEDKR----G | SKYPIFGTLK-EEKEYYKEFEFTIYHLRKHLV | 143 |
| WP_066269658 | 74 | RRQNRLRYLQEIFEEMNKVDENFFQRLDD-SFLV-EEDKR----G | ERHPIFGNIV-DEVAYHEKYPTIYHLRKKLA | 143 |
| WP_048800089 | 74 | RRQNRLRYLQEIFAEEMNKVDENFFQRLDD-SFLV-EEDKR----G | ERHPIFGNIV-DEVAYHEKYPTIYHLRKKLA | 143 |
| WP_012767106 | 74 | RRQNRIRYLQEIFSSEMSKVDDSFFHRLEE-SFLV-EEDKR----H | ERHPIFGNIV-DEVAYHEKYPTIYHLRKKLA | 143 |
| WP_014612333 | 74 | RRQNRIRYLQEIFSSEMSKVDDSFFHRLEE-SFLV-EEDKR----H | ERHPIFGNIV-DEVAYHEKYPTIYHLRKKLA | 143 |
| WP_015017095 | 74 | RRQNRIRYLQEIFSSSEMSKVDDSFFHRLEE-SFLV-EEDKK----H | ERHPIFGNIV-DEVAYHEKYPTIYHLRKKLA | 143 |
| WP_015057649 | 74 | RRQNRIRYLQEIFSSSEMSKVDDSFFHRLEE-SFLV-EEDKK----H | ERHPIFGNIV-DEVAYHEKYPTIYHLRKKLA | 143 |
| WP_048327215 | 74 | RRQNRIRYLQEIFSSSEMSKVDDSFFHRLEE-SFLV-EEDKK----H | ERHPIFGNIV-DEVAYHEKYPTIYHLRKKLA | 143 |
| WP_049519324 | 74 | RRQNRIRYLQEIFSSEMSKVDDGFFHRLEE-SFLV-EEDKK----G | NKHPIFANLA-DEVAYHKKYPTIYHLRKELV | 143 |
| WP_012515931 | 74 | RRKQNRLRYLKEIFTEEMAKVDDGFFHRLEE-SFYV-LEDKE----G | NKHPIFANLA-DEVAYHKKYPTIYHLRKELV | 143 |
| WP_021320964 | 74 | RRKQNRLRYLKEIFTEEMAKVDDGFFHRLED-SFYV-LEDKE----G | NKHPIFANLA-DEVAYHKKYPTIYHLRKHLA | 143 |
| WP_037581760 | 74 | RRKQNRLRFLKEIFTEEMAKVDDGFFHRLED-SFYV-LEDKE----G | DSHPIFGNKA-EEDYHQEFFPTIYHLRKHLA | 143 |
| WP_004232481 | 74 | RRKQNRLRYLQEIFAKEMAKVDDGFFHRLED-SFLT-TDEKD----F | ERHPIFGNKA-EEDAVHQKFPTIYHLRNYLA | 144 |
| WP_009854540 | 75 | RRKQNRLRYLQEIFAEEMTKVDESFFYRLDE-SFLT-TDDKD----F | ERHPIFGNKA-DEIKYHQEFPTIYHLRKHLA | 144 |
| WP_012962174 | 74 | RRKQNRLRYLQEIFAEEMAKVDESFFYRLDE-SFLT-TDDKD----F | ERHPIFGNKA-EEDAVHQKFPTIYHLRKHLA | 144 |
| WP_039695303 | 75 | RRKQNRLRYLQEIFAEEMAKVDESFFYRLDE-SFLT-TDDKT----F | DSHPIFGNKA-EEDAVHQKFPTIYHLRKHLA | 144 |
| WP_014334983 | 75 | RRKQNRLRYLQEIFANEIAKVDESFFYRLDE-SFLI-PEDKE----E | SKYPIFATLT-EEKEYHKQPPTIYHLRKQLA | 143 |
| WP_003099269 | 74 | RRKYRIKELQKIFSSEMNELDIAFFPRLSE-SFLV-SDDKE----F | SKYPIFATLI-EEKEYHENPPTIYHLRQYLA | 143 |
| AHY15608 | 74 | RRKYRIKELQKIFSSEMNELDIAFFPRLSE-SFLV-SDDKE----F | ERHPIFGNLE-EEVKYHENPPTIYHLRQYLA | 143 |
| AHY17476 | 74 | RRKYRIKELQKIFSSEMNELDIAFFPRLSE-SFLV-SDDKE----F | SKYPIFGTLE-EEKNYHKNYPTIYHLRKTLA | 143 |
| ESR09100 | | ---------------------------------- | ----------------------------- | |
| AGM98575 | 74 | RRRNRILYLQEIFSSEEMGKVDDSFFHRLED-SFLV-TEDKR----G | ERHPIFGNLE-EEVKYHENPPTIYHLRQYLA | 143 |
| ALF27331 | 74 | RRRNRILYLQEIFSSEEMGKVDDSFFHRLED-SFLV-TEDKR----G | ERHPIFGNLE-EEVKYHENPPTIYHLRQYLA | 143 |
| WP_018372492 | 74 | RRRNRLRYLQEIHIPAEEMRADENFFHRLKE-SFFV-EEDKT----Y | SKYPIFGTLE-EEKNYHKNYPTIYHLRKTLA | 143 |
| WP_045618028 | 75 | RRRNRLRYLQEIFSSEEMGKVDDSFFHRLDD-SFLV-PEDKE----F | SKYPIFATLE-EEKEYHKNFPTIYHLRKHLA | 143 |
| WP_045635197 | 74 | RRRNRILYLQEIFSSEEMGKVDDSFFHRLDD-SFLI-PEDKE----E | SKYPIFATLT-EEKEYHKQPPTIYHLRKQLA | 143 |
| WP_002263549 | 74 | RRRNRILYLQEIFSSEEMGKVDDSFFHRLED-SFLV-TEDKR----G | ERHPIFGNLE-EEVKYHENPPTIYHLRQYLA | 143 |
| WP_002263887 | 74 | RRRNRILYLQEIFSSEEMGKVDDSFFHRLED-SFLV-TEDKR----G | ERHPIFGNLE-EEVKYHENPPTIYHLRQYLA | 143 |
| WP_002264920 | 74 | RRRNRILYLQEIFSSEEMGKVDDSFFHRLED-SFLT-DDDKN----F | DSYPIFGNLE-EEVKYHENPPTIYHLRQYLA | 143 |
| WP_002269043 | 74 | RRRNRILYLQEIFSSEEMGKVDDSFFHRLED-SFLV-TEDKR----G | ERHPIFGNLE-EEVKYHENPPTIYHLRQYLA | 143 |
| WP_002269448 | 74 | RRRNRILYLQEIFSSEEMGKVDDSFFHRLED-SFLV-TEDKR----G | ERHPIFGNLE-EEVKYHENPPTIYHLRQYLA | 143 |
| WP_002271977 | 74 | RRRNRILYLQEIFSSEEMGKVDDSFFHRLED-SFLV-TEDKR----G | ERHPIFGNLE-EEVKYHENPPTIYHLRQYLA | 143 |

-continued

| | | | | |
|---|---|---|---|---|
| WP_002272766 | 74 | RRRNRILYLQEIFSEEMGKVDDSFFHRLED-SFLV--TEDKR---G | ERHPIFGNLE-EEVKYHENPTIYHLRQYLA | 143 |
| WP_002273241 | 74 | RRRNRILYLQEIFSEEMGKVDDSFFHRLED-SFLV--TEDKR---G | ERHPIFGNLE-EEVKYHENPTIYHLRQYLA | 143 |
| WP_002275430 | 74 | RRRNRILYLQEIFAEEMSKVDDSFFHRLED-SFLV--TEDKR---G | ERHPIFGNLE-EEVKYHENPTIYHLRQYLA | 143 |
| WP_002276448 | 74 | RRRNRILYLQEIFSEEMGKVDDSFFHRLDE-SFLV--TEDKR---G | ERHPIFGNLE-EEVKYHENPTIYHLRQYLA | 143 |
| WP_002277050 | 74 | RRRNRILYLQEIFSEEMGKVDDSFFHRLDE-SPLT--DDDKN---F | DSHPIFGNKA-EEDAYHQKPPTIYHLRKHLA | 143 |
| WP_002273364 | 74 | RRRNRILYLQEIFAEEMSKVDDSFFHRLED-SFLV--TEDKR---G | ERHPIFGNLE-EEVKYHENPTIYHLRQYLA | 143 |
| WP_002279025 | 74 | RRRNRILYLQEIFSEEMGKVDDSFFHRLED-FFLV--TEDKR---G | ERHPIFGNLE-EEVKYHENPTIYHLRQYLA | 143 |
| WP_002279859 | 74 | RRRNRILYLQEIFAEEMSKVDDSFFHRLDE-SFLT--DDDKN---F | DSHPIFGNKA-EEDAYHQKPPTIYHLRKHLA | 143 |
| WP_002280230 | 74 | RRRNRILYLQEIFAEEMSKVDDSFFHRLED-SFLV--TEDKR---G | ERHPIFGNLE-EEVKYHENPTIYHLRQYLA | 143 |
| WP_002281696 | 74 | RRRNRILYLQEIFAEEMSKVDDSFFHRLED-SFLV--TEDKR---G | ERHPIFGNLE-EEVKYHENPTIYHLRQYLA | 143 |
| WP_002282247 | 74 | RRRNRILYLQEIFAEEMSKVDDSFFHRLDE-SFLT--DDDKN---F | DSHPIFGNKA-EEDAYHQKPPTIYHLRKHLA | 143 |
| WP_002282906 | 74 | RRRNRILYLQEIFSEEMGKVDDSFFHRLED-SFLV--TEDKR---G | ERHPIFGNLE-EEVKYHENPTIYHLRQYLA | 143 |
| WP_002283846 | 74 | RRRNRILYLQEIFAEEMSKVDDSFFHRLED-SFLV--TEDKR---G | ERHPIFGNLE-EEVKYHENPTIYHLRQYLA | 143 |
| WP_002287255 | 74 | RRRNRILYLQEIFAEEMSKVDDSFFHRLED-SFLV--TEDKR---G | ERHPIFGNLE-EEVKYHENPTIYHLRQYLA | 143 |
| WP_002288990 | 74 | RRRNRILYLQEIFSEEMGKVDDSFFHRLED-SFLV--TEDKR---G | ERHPIFGNLE-EEVKYHENPTIYHLRQYLA | 143 |
| WP_002289641 | 74 | RRRNRILYLQEIFSEEMGKVDDSFFHRLED-SFLV--TEDKR---G | ERHPIFGNLE-EEVKYHENPTIYHLRQYLA | 143 |
| WP_002290427 | 74 | RRRNRILYLQEIFSEEMGKVDDSFFHRLED-SFLV--TEDKR---G | ERHPIFGNLE-EEVKYHENPTIYHLRQYLA | 143 |
| WP_002295753 | 74 | RRRNRILYLQEIFSEEMGKVNDSFFHRLED-SFLV--TEDKR---G | ERHPIFGNLE-EEVKYHENPTIYHLRQYLA | 143 |
| WP_002296423 | 74 | RRRNRILYLQEIFSEEMGKVDDSFFHRLED-SFLV--TEDKR---G | ERHPIFGNLE-EEVKYHENPTIYHLRQYLA | 143 |
| WP_002304487 | 74 | RRRNRILYLQEIFAEEMMQVDEFFQRLDD-SFLV--BEDKR---G | SRYPIFGTLK-EEKKYHKEFKTIYHLREKLA | 143 |
| WP_002305844 | 74 | RRRNRILYLQEIFSEEMDKVDDSFFHRLED-SFLV--TEDKR---G | ERHPIFGNLE-EEVKYHENPTIYHLRQYLA | 143 |
| WP_002307203 | 74 | RRRNRILYLQEIFSEEMGKVDDSFFHRLED-SFLV--TEDKR---G | ERHPIFGNLE-EEVKYHENPTIYHLRQYLA | 143 |
| WP_002310390 | 74 | RRRNRILYLQEIFAEEMSKVDDSFFHRLED-SFLV--TEDKR---G | ERHPIFGNLE-EEVKYHENPTIYHLRQYLA | 143 |
| WP_002352408 | 74 | RRRNRILYLQEIFAEEMGKVDDSFFHRLDE-SFLT--DDDKN---F | DSHPIFGNKA-EEDAYHQKPPTIYHLRKHLA | 143 |
| WP_012997688 | 74 | RRRNRILYLQEIFAEEMGKVDDSFFHRLED-SFLV--TEDKR---G | ERHPIFGNLE-EEVKYHENPTIYHLRQYLA | 143 |
| WP_014677909 | 74 | RRRNRILYLQEIFSEEMGKVDDSFFHRLED-SFLV--TEDKR---G | ERHPIFGNLE-EEVKYHENPTIYHLRQYLA | 143 |
| WP_019312892 | 74 | RRRNRILYLQEIFAEEMSKVDDSFFHRLED-SFLV--TEDKR---G | ERHPIFGNLE-EEVKYHENPTIYHLRQYLA | 143 |
| WP_019313659 | 74 | RRRNRILYLQEIFSEEMGKVDDSFFHRLED-SFLV--TEDKR---G | ERHPIFGNLE-EEVKYHENPTIYHLRQYLA | 143 |
| WP_019314093 | 74 | RRRNRILYLQEIFSEEMGKVDDSFFHRLDE-SFLV--TEDKR---G | ECHPIFGNLE-EEVKYHENPTIYHLRQYLA | 143 |
| WP_019315370 | 74 | RRRNRILYLQEIFSEEMGKVDDSFFHRLED-SFLV--TEDKR---G | ERHPIFGNLE-EEVKYHENPTIYHLRQYLA | 143 |
| WP_019803776 | 74 | RRRNRILYLQEIFSEEMGKVDDSFFHRLED-SFLV--TEDKR---G | ERHPIFGNLE-EEVKYHENPTIYHLRQYLA | 143 |
| WP_019805234 | 74 | RRRNRILYLQEIFSEEMGKVDDSFFHRLDE-SFLT--DDDKN---F | DSHPIFGNKA-EEDAYHQKPPTIYHLRKHLA | 143 |
| WP_024783594 | 74 | RRRNRILYLQEIFSEEMGKVDDSFFHRLED-SFLV--TEDKR---G | ERHPIFGNLE-EEVKYHENPTIYHLRQYLA | 143 |
| WP_024784288 | 74 | RRRNRILYLQEIFAEEMSKVDDSFFHRLED-SFLV--TEDKR---G | ERHPIFGNLE-EEVKYHENPTIYHLRQYLA | 143 |
| WP_024784666 | 74 | RRRNRILYLQEIFSEEMGKVDDSFFHRLED-SFLV--TEDKR---G | ERHPIFGNLE-EEVKYHENPTIYHLRQYLA | 143 |
| WP_024784894 | 74 | RRRNRILYLQEIFAEEMSKVDDSFFHRLDE-SFLT--DDDKN---F | DSHPIFGNKA-EEDAYHQKPPTIYHLRKHLA | 143 |
| WP_024786433 | 74 | RRRNRILYLQEIFAEEMNKVDDSFFHRLDE-SFLH--KSDKR---Y | EAHPIFGTLQ-EEKAYHDNYPTIYHLRKALA | 143 |
| WP_049473442 | 74 | RRRNRILYLQEIFAEEMNKVDDSFFHRLDD-SFLV--PEDKR---G | ERHPIFGNLE-EEVKYENPTIYHLRQYLA | 143 |
| WP_049474547 | 74 | RRRNRILYLQEIFAEEMNKVDSSFFHRLDD-SFLV--PEDKR---G | ERHPIFGNLE-EEVKYHENPTIYHLRQYLA | 143 |
| EMC03581 | 67 | RRRNRILYLQEIFAEEMNKVDDSFFHRLDD-SFLV--PEDKR---G | ERHPIFGNLE-EEVKYHENPTIYHLRQYLA | 136 |
| WP_000428612 | 75 | RRKNRLRYLQEIFAEEMSKVDSFFHRLDD-SFLI--PEDKK---G | SKYPIFATLI-EEKEYHKQPPTIYHLRKQLA | 144 |
| WP_000428613 | 74 | RRKNRLRYLQEIFAEEMSKVDSFFHRLDD-SFLI--PEDKR---G | SKYPIFATLA-EEKEYHKQPPTIYHLRKQLA | 143 |
| WP_049523028 | 75 | RRRNRILYLQEIFSEEMGKVDDSFFHRLDD-SFLV--PEDKR---G | SKYPIFGTLE-EEKEYHKQPPTIYHLRKILA | 144 |
| WP_003107102 | 43 | RRINRIKYLQSIFDDEMSKIDSAFFQRIKD-SFLV--PDDDKN---D | DRHPIFGNIK-DEVDYHKNYPTIYHLRKALA | 112 |
| WP_054279288 | 76 | RRKNRLCYLRDIFESEMTIDKHFFLRLED-SFLH--KSDKR---Y | EAHPIFGTLQ-EEKAYHDNYPTIYHLRKALA | 145 |
| WP_049531101 | 75 | RRKNRLRYLQEIFAEEMNKVDSSFFHRLDD-SFLV--PEDKR---G | SKYPIFATLT-EEKEYYKQPPTIYHLRKQLA | 144 |
| WP_049538452 | 75 | RRKNRLRYLQEIFAEEMNKVDSSFFHRLDD-SFLV--PEDKR---G | SKYPIFATLV-EEKEYHKNPTIYHLRKQLA | 144 |
| WP_049549711 | 75 | RRKNRLRYLQEIFSGEMSKVDDTFFHRLDD-SFLI--PEDKK---G | DKHPIFGNSK-EERAYHKTYPTIYHLRKDLA | 144 |
| WP_007896501 | 76 | RRRYRLCQLQNIFATEMVKVDDTFFQRLSE-SFFY--YQDKA---F | DKHPIFGNSK-EERAYHKTYPTIYHLRKDLA | 145 |
| EFR44625 | 28 | RRRNRILYLQEIFTESMNEIDESFFHRLDD-SFFY--YQDKR---G | SKYPIFATLQ-EEKEYHKQPPTIYHLRKDLA | 97 |
| WP_002897477 | 74 | RRRNRLRYLQEIFSEEISKLDSSFFHRLDD-SFLV--PEDKR---G | SKYPIFATLE-EEKEYHKKPPTIYHLRKHLA | 143 |
| WP_002906454 | 74 | RRRNRLRYLQEIFSEEISKLDSSFFHRLDD-SFLV--PEDKR---G | SKYPIFATLE-EEKEYHKKPPTIYHLRKHLA | 143 |
| WP_009729476 | 75 | RRKNRLRYLQEIFSEEIGKVDSSFFHRLDD-SFLI--PEDKR---G | SKYPIFATLA-EEKKYHKQPPTIYHLRKDLA | 144 |

-continued

```
CQR24647         74  RRRNRILYLQDIFSPELNQVDESFLHRLDD-SFLVa--EDKR---G  ERHVIFGNIA-DEVKYHKEFPTIYHLRKHLA      143
WP_000066813     75  RRRNRLRYLQEIFSQEISKVDSSFFHRLDD-FFLIV--PEDKR---G  SKYPIFATLV-EEKEYHKKFPTIYHLRKHLA      144
WP_009754323     75  RRRNRLRYLQEIFAEEMSKVDSSFFHRLDD-SFLIV--PEDKS---G  SKYPIFATLA-EEKEYHKKFPTIYHLRKHLA      144
WP_044674937     74  RRRNRILYLQEIFAEEINKIDSSFFQRLDD-SFLIV--EDKQ---G  SKHPIFGTLQ-EEKKEYHKQFPTIYHLRKQLA      143
WP_044676715     74  RRRNRILYLQEIFAEEINKIDSSFFQRLDD-SFLIV--EDKQ---G  SKHPIFGTLQ-EEKEYHKQPPTIYHLRKQLA      143
WP_044680361     74  RRRNRLRYLQEIFAEEINKIDDSFFQRLDD-SFLIV--EDKQ---G  SKHPIFGTLQ-EEKKYHKQPPTIYHLRKQLA      143
WP_044681799     74  RRRNRLRYLQEIFAEEINKIDDSFFQRLDD-SFLIV--EDKQ---G  SKHPIFGTLQ-EEKKYHKQPPTIYHLRKQLA      143
WP_049533112     74  RRRNRLRYLQEIFAEEMNKVDENFFQRLDD-SFLIV--DEDKR---G  ERHPIFGNIA-AEVKYHDDFPTIYHLRKHLA      143
WP_029090905     28  HRKFPRLRLLEDMFEKEILSKDPSFFIRLKE-AFLSpkDEQKQ--F  ---LFNDKDyTDADYYEQYKTIYHLRYDLI        100
WP_065066696     61  KRRERIRLLRAILQDMVLEKDPTFFIRLEHt SFLD--EEDKAKy1G  DNYNLFIDEDFNDYTYHKYPTIYHLRKALC       139
AIT42264         74  RRRNRLRYLQEIFSNEMAKVDDSFFHRLDE-SFLIV--EEDKE---H  ERHPIFGNIV-DEVAYHEKYPTIYHLRKKLV      144
WP_034440723     73  RRRFPRIRELQKIFDKSMGEVDSNFFHRLDE-SFLIV--EEDKE---Y  SKYPIFSNEK-EDKNYDKYPTIYHLRKDLA      142
AKQ21048         74  RRRNRICYLQEIFSNEMAKVDDSFFHRLDE-SFLIV--EEDKK---H  ERHPIFGNIV-DEVAYHEKYPTIYHLRKKLV      143
WP_004636532     74  RRRNRILYLQDIFQQPMLAIDENFFHRLDD-SFFV--PDDKS---Y  DRHPIFGSLE-EEVAYHNTYPTIYHLRKKLA       143
WP_002364836     74  RRRNRLRYLQAFFEEAMTDLDENFFARLQE-SFLIV--PEDKK---W  HRHPIFAKLE-DEVAYHETYPTIYHLRKKLA       143
WP_016631044     25  RRRNRLRYLQAFFEEAMTDLDENFFARLQE-SFLIV--PEDKK---W  HRHPIFAKLE-DEVAYHETYPTIYHLRKKLA        94
EMS75795             -----------------------------------------------  -----------------------------
WP_002373311     74  RRRNRLRYLQAFFEEAMTDLDENFFARLQE-SFLIV--PEDKK---W  HRHPIFAKLE-DEVAYHETYPTIYHLRKKLA      143
WP_002378009     74  RRRNRLRYLQAFFEEAMTALDENFFARLQE-SFLIV--PEDKK---W  HRHPIFAKLE-DEVAYHETYPTIYHLRKKLA      143
WP_002407324     74  RRRNRLRYLQAFFEEAMTALDENFFARLQE-SFLIV--PEDKK---W  HRHPIFAKLE-DEVAYHETYPTIYHLRKKLA      143
WP_002413717     74  RRRNRLRYLQAFFEEAMTALDENFFARLQE-SFLIV--PEDKK---W  HRHPIFAKLE-DEVAYHETYPTIYHLRKKLA      143
WP_010775580     74  RRRNRLRYLQAFFEEAMTALDENFFARLQE-SFLIV--PEDKK---W  HRHPIFAKLE-DEVAYHETYPTIYHLRKKLA      143
WP_010818269     74  RRRNRLRYLQAFFEEAMTALDENFFARLQE-SFLIV--PEDKK---W  HRHPIFAKLE-DEVAYHETYPTIYHLRKKLA      143
WP_010824395     74  RRRNRLRYLQAFFEEAMTDLDENFFARLQE-SFLIV--PEDKK---W  HRHPIFAKLE-DEVAYHETYPTIYHLRKKLA      143
WP_016622645     74  RRRNRLRYLQAFFEEAMTALDENFFARLQE-SFLIV--PEDKK---W  HRHPIFAKLE-DEVAYHETYPTIYHLRKKLA      143
WP_033624816     74  RRRNRLRYLQAFFEEAMTALDENFFARLQE-SFLIV--PEDKK---W  HRHPIFAKLE-DEVAYHETYPTIYHLRKKLA      143
WP_002625576     74  RRRNRLRYLQAFFEEAMTALDENFFARLQE-SFLIV--PEDKK---W  HRHPIFAKLE-DEVAYHETYPTIYHLRKKLA      143
WP_033789179     74  RRRNRLRYLQAFFEEAMTALDENFFARLQE-SFLIV--PEDKK---W  HRHPIFAKLE-DEVAYHETYPTIYHLRKKLA      143
WP_002310644     74  RRRQRILELQKIFAPEILKIDEHFFARLNE-SFLIV--PEDKK---Q  SRHPVFATIK-QEKSYHQTYPTIYHLRQALA      143
WP_002312694     74  RRRQRILELQKIFAPEILKIDEHFFARLNE-SFLIV--LDEKK---Q  SRHPVFATIK-QEKSYHQTYPTIYHLRQALA      143
WP_002314015     74  RRRQRILELQKIFAPEILKIDEHFFARLNE-SFLIV--PDEKK---Q  SRHPVFATIK-QEKSYHQTYPTIYHLRQALA      143
WP_002320716     74  RRRQRILELQKIFAPEILKIDEHFFARLNE-SFLIV--LDEKK---Q  SRHPVFATIK-QEKSYHQTYPTIYHLRQALA      143
WP_002330729     74  RRRQRILELQKIFAPEILKIDEHFFARLNE-SFLIV--LDEKK---Q  SRHPVFATIK-QEKSYHQTYPTIYHLRQALA      143
WP_002335161     74  RRRQRILELQKIFAPEILKIDEHFFARLNE-SFLIV--LDEKK---Q  SRHPVFATIK-QEKSYHQTYPTIYHLRQALA      143
WP_002345439     74  RRKYRLSKLQDLFAEELCKQDDCFFVRLEE-SFLIV--LDEKK---Q  KPASIFPTLE-EEKEYYQKYPTIYHLRQALA      143
WP_034867970     74  RRKYRLSKLQDLFAEELCKQDDCFFVRLEE-SFLIV--PEEKQ---Y  KPASIFPTLE-EEKEYYQKYPTIYHLRQKLV      143
WP_047937432     74  RRRQRILELQKIFAPEILKIDEHFFARLNE-SFLIV--PEEKQ---Y  SRHPVFATIK-QEKSYHQTYPTIYHLRQALA      143
WP_010720994     74  RRKYRLSKLQDLFAEELCKQDDCFFVRLEE-SFLIV--PEEKQ---Y  KPASIFPTLE-EEKEYYQKYPTIYHLRQKLV      143
WP_010737004     74  RRKYRLSKLQDLFAEELCKQDDCFFVRLEE-SFLIV--PEEKQ---Y  KPASIFPTLE-EEKEYYQKYPTIYHLRQKLV      143
WP_034700478     74  RRRQRILELQKIFQPEMNLKYPFFYRLNE-SFLVa--DDAK---Y  DKHPIFGTLD-EEIHFHEQFPTIYHLRQKLV       143
WP_047209003     74  RRRQRILELQKIFQPEMNLKYPFFYRLNE-SFLVa--DDAK---Y  DKHPIFGTLD-EEIHFHEQFPTIYHLRQKLA       143
WP_023519017     74  RRRQRVLALQDIFAEEIHKKDPNFFARLEE-GDRV--EADKR---F  AKFPVFATLS-EEKNVHRQYPTIYHLRHDLA        143
WP_010770040     74  RRRNRCRLQDLFTEEMNQVDANFFHRLQE-SFLIV--PDEKE---F  ERHPIFGKME-EEVSYREFPTIYHLRKHLA         143
WP_048604708     74  RRRQRISYLQTFPQEEMNRIDPNFFNRLDE-SFLIV--EEDKL---S  ERHPIFGTIE-EEVAYHKNYATIYHLRKELA       143
KDA45870         75  RRRNRLRYLQEIFAPALAKVDPNFFYRLEE-SSLVa--EEDKK---Y  ARFPIFPTLL-EEKAYYQNYPTIYHLRSELA       144
WP_010750235     74  RRKYRLELQKIFSEEILKKDSHFFARLDE-SFLI--EEDKL---Y  DVYPIFGKRE-EELLYHDTHKTIYHLRSELA         143
WP_039099354         ---------------------------------------------  ----QTSLFNDRT--DRAFYDYPTIYHLREFPTIYHLRYKLM      132
AII16583        113  RRKWRLGLLREIFEPYITPVDDTFFLRKKQ-SNLS--PKDQR---K  -QTSLFNDRT--DRAFYDYPTIYHLREFPTIYHLRYKLM       182
WP_029073316     66  KRREREIRLLRGIMEDMVLDVDPTFFIRLANVSFLD-QEDKKdy1K  DKYNLFIDKDTYDKEYYREFPTIFHLRKELI       144
WP_031589969     66  KRREREIRLLREIMEDMVLDVDPTFFIRLANVSFLD-QEDKKdy1K  SNYNLFIDKDFNDKTYYDKYPTIYHLRKHLC        144
AKP02966         65  RRKNRIWLNEIFSEELANTDPSFLIRLQN-SMVSKdPDDRK---R  DKYNLFIDNPYTDKEYYREFPTIFHLRKELI         137
WP_010991369     74  RRKNRINSYLQGIFAEEMSKTDANFFCRLSD-SFYV--DNEKR---N  SRHPFFATIE-EEVEYHKNYPTIYHLREELV      143
WP_033838504     74  RRRNRISYLQGIFAEEMSKTDANFFCRLSD-SFYV--DNEKR---N  SRHPFFATIE-EEVEYHKNYPTIYHLREELV       143
```

```
EHN60060          77  RRRNRIRISYLQGIFPAEEMSKTDANFFCRLSD-SFYV--DNEKR---N    SRHPFFATIE-EEVEYHKNYPTIYHLREELV  146
EFR89594              
WP_038409211      74  RRRNRIAYLQEIFPAAEMAEVDANFFYRLED-SFYI--ESEKR---H    SRHPFFATIE-EEVAYHEEYKTIYHLREKLV  143
EFR95520              
WP_003723650      74  RRRNRISYLQEIFPAVEMANIDANFFCRLND-SFYV--DSEKR---N    SRHPFFATIE-EEVAYHDNVRTIYHLREELV  143
WP_003727705      74  RRRNRISYLQEIFPAVEMANIDANFFCRLND-SFYV--DSEKR---N    SRHPFFATIE-EEVAYHKNVRTIYHLREELV  143
WP_003730785      74  RRRNRISYLQEIFPAVEMANIDANFFCRLND-SFYV--DSEKR---N    SRHPFFATIE-EEVAYHKNVRTIYHLREELV  143
WP_003733029      74  RRRNRISYLQEIFAIQMNEVDDNFFNRLKE-SFYA--ESDKK---Y    NRHPFGTVE-EEVAYHKNVRTIYHLREELV  143
WP_003739838      74  RRRNRISYLQEIFALEMANIDANFFCRLND-SFYV--DSEKR---N    SRHPFFATIE-EEVAYHKNVRTIYHLREELV  143
WP_014601172      74  RRRNRISYLQEIFPAVEMANIDANFFCRLND-SFYV--DSEKR---N    SRHPFFATIE-EEVAYHKNVRTIYHLREELV  143
WP_023548323      74  RRRNRISYLQEIFPAVEMANIDANFFCRLND-SFYV--DSEKR---N    SRHPFFATIE-EEVAYHKNVRTIYHLREELV  143
WP_031665337      74  RRRNRISYLQEIFPAVEMANIDANFFCRLND-SFYV--DSEKR---N    SRHPFFATIE-EEVAYHKNVRTIYHLREELV  143
WP_031669209      74  RRRNRISYLQEIFAIQMNEVDDNFFNRLKE-SFYA--ESDKK---Y    NRHPFGTVE-EEVAYYKDPTIYHLREELV  143
WP_033920898      74  RRRNRISYLQEIFPAVEMANIDANFFCRLND-SFYV--DSEKR---N    SRHPFFATIE-EEVAYHKNVRTIYHLREELV  143
AKI42028          74  RRRNRISYLQEIFPAVEMANIDANFFCRLND-SFYV--DSEKR---N    SRHPFFATIE-EEVAYHKNVRTIYHLRKELI  143
AKI50529          77  RRRNRISYLQEIFPAVEMANIDANFFCRLND-SFYV--DSEKR---N    SRHPFFATIE-EEVAYHKNVRTIYHLREELV  146
EFR83390              
WP_046323366      74  RRRNRICYLQEIFTAEMPEVDANFFYRLED-SFYI--ESEKR---Q    SRHPFFATIE-EEVAYHENVRTIYHLREKLV  143
AKE81011          90  RRKNRICYLQEIFSNEMAKVDDSFFHRLEE-SFLIV--FEDKK---H    ERHPIPGNIV-DEVAYHEKPTIYHLRKKLV  159
CU082355          65  KRRERIRLLRAILQDMVLEKDPTFFIRLEHtSFPLD--EEDKAkylG    DNYNLFIDEDfNDYTYHKNVPTIYHLRKALC  143
WP_033162887      66  KRRERIRLLRDLLGDMVMEVDPTFFIRLLNvSFPLD--EEDKQkn1G    DNYNLFIEKDFNDKTYYDKPTIYHLRKELC  144
AGZ01981         107  RRKNRICYLQEIFSNEMAKVDDSFFHRLEE-SFLV---EEDKK---H    ERHPIPGNIV-DEVAYHEKPTIYHLRKKLV  176
AKA60242          74  RRKNRICYLQEIFSNEMAKVDDSFFHRLEE-SFLV---EEDKK---H    ERHPIPGNIV-DEVAYHEKPTIYHLRKKLV  143
AKS40380          74  RRKNRICYLQEIFSNEMAKVDDSFFHRLEE-SFLV---EEDKK---H    ERHPIPGNIV-DEVAYHEKPTIYHLRKKLV  143
4UN5_B            78  RRKNRICYLQEIFSNEMAKVDDSFFHRLEE-SFLIV--EEDKK---H    ERHPIPGNIV-DEVAYHEKPTIYHLRKKLV  147

WP_010922251     144  DSTDKADLRLIYLALAHMIKFRGHFLIEGD-LNPDNSDV[D]KL--FIQLVQTYNQL--FEEN--                                  211
WP_039695303     145  DSSEKADLRLIYLALAHMIKFRGHFLIEGE-LNAENTDVQKI--FADFVGVYNRT-FDDS-H   INASGVDAK---AI               212
WP_045635197     144  DSKEKTDLRLIYLALAHMIKYRGHFLYEEA-FDIKNNDIQKI--FNEFISIYDNT-FEGS-S   LSEITVDVA---SI               211
5AXW_A           105  EEEFSA------ALLHLAKRRG--VHNV---NEVE------EDT------GN--            LSGQNAQVE---AI               134
WP_009880683                                                                                           -------E---
WP_010922251     144  DSTDKADLRLIYLALAHMIKFRGHFLIEGD-LNPDNSDVDKL--FIQLVQTYNQL--FEEN--   INASGVDAK---AI               211
WP_011054416     144  DSTDKVDLRLIYLALAHMIKFRGHFLIEGD-LNPDNSDVDKL--FIQLVQTYNQL--FEEN--   INASRVDAK---AI               211
WP_011284745     144  DSTDKADLRLIYLALAHMIKFRGHFLIEGD-LNPDNSDVDKL--FIQLVQTYNQL--FEEN--   INASRVDAK---AI               211
WP_011285506     144  DSTDKADLRLIYLALAHMIKFRGHFLIEGD-LNPDNSDVDKL--FIQLVQTYNQL--FEEN--   INASGVDAK---AI               211
WP_011527619     144  DSTDKADLRLIYLALAHMIKFRGHFLIEGD-LNPDNSDVDKL--FIQLVQTYNQL--FEEN--   INASGVDAK---AI               211
WP_012560673     144  DSTDKADLRLIYLALAHMIKFRGHFLIEGD-LNPDNSDVDKL--FIQLVQTYNQL--FEEN--   INASRVDAK---AI               211
WP_014407541     144  DSTDKVDLRLIYLALAHMIKFRGHFLIEGD-LNPDNSDVDKL--FIQLVQTYNQL--FEEN--   INASRVDAK---AI               211
WP_020905136     144  DSTDKADLRLIYLALAHMIKFRGHFLIEGG-LNPDNSDVDKL--FIQLVQTYNQL--FEEN--   INASGVDAK---AI               211
WP_023080005     144  DSTDKADLRLIYLALAHMIKFRGHFLIEGD-LNPDNSDVDKL--FIQLVQTYNQL--FEEN--   INASRVDAK---AI               211
WP_023610282     144  DSTDKADLRLIYLALAHMIKFRGHFLIEGD-LNPDNSDVDKL--FIQLVQTYNQL--FEEN--   INASRVDAK---AI               211
WP_030125963     144  DSTDKADLRLIYLALAHMIKFRGHFLIEGD-LNPDNSDVDKL--FIQLVQTYNQL--FEEN--   INASRVDAK---AI               211
WP_030126706     144  DSTDKADLRLIYLALAHMIKFRGHFLIEGD-LNPDNSDVDKL--FIQLVQTYNQL--FEEN--   INASRVDAK---AI               211
WP_031488318     144  DSTDKADLRLIYLALAHMIKFRGHFLIEGD-LNPDNSDVDKL--FIQLVQTYNQL--FEEN--   INASRVDAK---AI               211
WP_032460140     144  DSTDKADLRLIYLALAHMIKFRGHFLIEGD-LNPDNSDVDKL--FIQLVQTYNQL--FEEN--   INASRVDAK---AI               211
WP_032461047     144  DSTDKADLRLIYLALAHMIKFRGHFLIEGD-LNPDNSDVDKL--FIQLVQTYNQL--FEEN--   INASRVDAK---AI               211
WP_032462016     144  DSTDKADLRLIYLALAHMIKFRGHFLIEGD-LNPDNSDVDKL--FIQLVQTYNQL--FEEN--   INANGVDAK---AI               211
WP_032462936     144  DSTDKADLRLIYLALAHMIKFRGHFLIEGD-LNPDNSDVDKL--FIQLVQTYNQL--FEEN--   INASGVDAK---AI               211
WP_032464890       1  -----------------------------------PDNSDVDKL--FIQLVQTYNQL--FEEN--   INASRVDAK---AI                36
WP_033888930                                                                                           
WP_038431314     144  DSTDKADLRLIYLALAHMIKFRGHFLIEGD-LNPDNSDVDKL--FIQLVQTYNQL--FEEN--   INASRVDAK---AI               211
```

| | | | |
|---|---|---|---|
| WP_038432938 | 144 | DSTDKVDLRLIYLALAHMIKFRGHFLIEGD-LNPDNSDVDKL---FIQLVQTYNQL--FEEN-- | INASRVDAK----AI | 211 |
| WP_038434062 | 144 | DSTDKADLRLIYLALAHMIKFRGHFLIEGD-LNPDNSDVDKL---FIQLVQTYNQL--FEEN-- | INASRVDAK----AI | 211 |
| BAQ51233 | 55 | DSTDKADLRLIYLALAHMIKFRGHFLIEGD-LNPDNSDVDKL---FIQLVQTYNQL--FEEN-- | INASGVDAK----AI | 122 |
| KGE60162 | | | | |
| KGE60856 | | | | |
| WP_002989955 | 144 | DSTDKADLRLIYLALAHMIKFRGHFLIEGD-LNPDNSDVDKL---FIQLVQTYNQL--FEEN-- | INASGVDAK----AI | 211 |
| WP_003030002 | 144 | DISQKADLRLIYLALAHMIKFRGHFLIEGQ-LKAENTNVQAL--FKDFVEVVDKT--VEES-H | LSEMTVDAL----SI | 211 |
| WP_003065552 | 147 | DSSEKADLRLVYLALAHMIKFRGHFLIEGE-LNAENTDVQKI--FADFVGVYDRT--FDDS-H | LSEITVDAA----SI | 214 |
| WP_001040076 | 144 | DKQEKADLRLIYLALAHIIKFRGHFLIEDDrFDVRNTDIQKQ--YQAFLEIFDTT--FENN-D | LLSQDVDVE----AI | 212 |
| WP_001040078 | 144 | DKKEKADLRLIYLALAHIIKFRGHFLIEDDrFDVRNTDISKQ--YQDFLEIFNIT--FENN-H | LLSQNVDVE----AI | 212 |
| WP_001040080 | 144 | DKKEKADLRLIYLALAHIIKFRGHFLIEDDsFDVRNTDISKQ--YQDFLEIFNTT--FENN-D | LLSQNVDVE----AI | 212 |
| WP_001040081 | 144 | DKKEKADLRLIYLALAHIIKFRGHFLIEDDsFDVRNTDISKQ--YQDFLEIFNTT--FENN-D | LLSQNVDVE----AI | 212 |
| WP_001040083 | 144 | DKKEKADLRLIYLALAHIIKFRGHFLIEDDsFDVRNTDISKQ--YQDFLEIFNTT--FENN-D | LLSQNVDVE----AI | 212 |
| WP_001040085 | 144 | DKKEKADLRLIYLALAHIIKFRGHFLIEDDsFDVRNTDISKQ--YQDFLEIFNTT--FENN-D | LLSQNVDVE----AI | 212 |
| WP_001040087 | 144 | DKKEKADLRLIYLALAHIIKFRGHFLIEDDsFDVRNTDISKQ--YQDFLEIFNTT--FENN-D | LLSQNVDVE----AI | 212 |
| WP_001040088 | 144 | DKKEKADLRLIYLALAHIIKFRGHFLIEDDsFDVRNTDISKQ--YQDFLEIFNTT--FENN-D | LLSQNVDVE----AI | 212 |
| WP_001040089 | 144 | DKKEKADLRLIYLALAHIIKFRGHFLIEDDsFDVRNTDISKQ--YQAFLEIFDTS--FENN-H | LLSQNVDVE----AI | 212 |
| WP_001040090 | 144 | DKKEKADLRLIYLALAHIIKFRGHFLIEDDsFDVRNTDISKQ--YQAFLEIFDTT--FENN-D | LLSQNVDVE----AI | 212 |
| WP_001040091 | 144 | DKKEKADLRLIYLALAHIIKFRGHFLIEDDsFDVRNTDISKQ--YQDFLEIFNTT--FENN-D | LLSQNVDVE----AI | 212 |
| WP_001040092 | 144 | DKKEKADLRLIYLALAHIIKFRGHFLIEDDsFDVRNTDIKQ---YQAFLEIFDTS--FENN-H | LLSQNVDVE----AI | 212 |
| WP_001040094 | 144 | DKKEKADLRLIYLALAHIIKFRGHFLIEDDsFDVRNTDIQKQ--YQAFLEIFDTT--FENN-D | LLSQNVDVE----AI | 212 |
| WP_001040095 | 144 | DKKEKADLRLIYLALAHIIKFRGHFLIEDDrFDVRNTDISKQ--YQAFLEIFDTT--FENN-D | LLSQNVDVE----AI | 212 |
| WP_001040096 | 144 | DKKEKADLRLIYLALAHIIKFRGHFLIEDDrFDVRNTDISKQ--YQDFLEIFNTT--FENN-H | LLSQNVDVE----AI | 212 |
| WP_001040097 | 144 | DKKEKADLRLIYLALAHIIKFRGHFLIEDDsFDVRNTDISKQ--YQAFLEIFDTT--FENN-D | LLSQNVDVE----AI | 212 |
| WP_001040098 | 144 | DKKEKADLRLIYLALAHIIKFRGHFLIEDDsFDVRNTDISKQ--YQDFLEIFNTT--FENN-H | LLSQNVDVE----AI | 212 |
| WP_001040099 | 144 | DKKEKADLRLIYLALAHIIKFRGHFLIEDDrFDVRNTDISKQ--YQDFLEIFNTT--FENN-D | LLSQNVDVE----AI | 212 |
| WP_001040100 | 144 | DKKEKADLRLIYLALAHIIKFRGHFLIEDDsFDVRNTDISKQ--YQDFLEIFNTT--FENN-D | LLSQNVDVE----AI | 212 |
| WP_001040104 | 144 | DKKEKANLRLIYLALAHIIKFRGHFLIEDDsFDVRNTDISKQ--YQDFLEIFNTT--FENN-D | LLSQNIDVE----GI | 212 |
| WP_001040105 | 144 | DKKEKADLRLIYLALAHIIKFRGHFLIEDDsFDVRNTDISKQ--YQDFLEIFNTT--FENN-D | LLSQNIDVE----GI | 212 |
| WP_001040106 | 144 | DKKEKANLRLIYLALAHIIKFRGHFLIEDDsFDVRNTDIQRQ--YQDFLEIFNTT--FENN-H | LLSQNVDVE----GI | 212 |
| WP_001040107 | 144 | DKKEKADLRLIYLALAHIIKFRGHFLIEDDsFDVRNTDIQRQ--YQAFLEIFDTT--FENN-H | LLSQNVDVE----GI | 212 |
| WP_001040108 | 144 | DKKEKADLRLIYLALAHIIKFRGHFLIEDDsFDVRNTDIQRQ--YQAFLEIFDTT--FENN-H | LLSQNIDVE----GI | 212 |
| WP_001040109 | 144 | DKKEKADLRLIYLALAHIIKFRGHFLIEDDsFDVRNTDISKQ--YQDFLEIFNTT--FENN-D | LLSQNIDVE----GI | 212 |
| WP_001040110 | 144 | DKKEKADLRLIYLALAHIIKFRGHFLIEDDsFDVRNTDIQRQ--YQAFLEIFDTT--FENN-H | LLSQNVDVE----GI | 212 |
| WP_015058523 | 144 | DKKEKADLRLIYLALAHIIKFRGHFLIEDDrFDVRNTDISKQ--YQAFLEIFDTS--FENN-H | LLSQNVDVE----GI | 212 |
| WP_017643650 | 144 | DKKEKADLRLIYLALAHIIKFRGHFLIEDDsFDVRNTDIQRQ--YQAFLEIFDTT--FENN-D | LLSQNVDVE----AI | 212 |
| WP_017647151 | 144 | DKKEKADLRLFYLALAHIIKFRGHFLIEDDsFDVRNTDIQRQ--YQAFLEIFDTT--FENN-H | LLSQNIDIE----GI | 212 |
| WP_017648376 | 144 | DKKEKADLRLIYLALAHIIKFRGHFLIEDDsFDVRNTDIQRQ--YQAFLEIFDTT--FENN-H | LLSQNVDVE----GI | 212 |
| WP_017649527 | 144 | DKKEKADLRLIYLALAHIIKFRGHFLIEDDsFDVRNTDISKQ--YQDFLEIFNTT--FENN-D | LLSQNIDVE----AI | 212 |
| WP_017771611 | 144 | DKKEKADLRLIYLALAHIIKFRGHFLIEDDsFDVRNTDISKQ--YQDFLEIFNTT--FENN-D | LLSQNIDVE----AI | 212 |
| WP_017771984 | 144 | DKKEKADLRLIYLALAHIIKFRGHFLIEDDsFDVRNTDISKQ--YQDFLEIFNTT--FENN-D | LLSQNIDVE----AI | 212 |
| CFQ25032 | 144 | DKKEKADLRLIYLALAHIIKFRGHFLIEDDsFDVRNTDISKQ--YQDFLEIFNTS--FENN-D | LLSQNVDVE----AI | 212 |
| CFV16040 | 144 | DKKEKADLRLIYLALAHIIKFRGHFLIEDDsFDVRNTDIQRQ--YQDFLEIFNTT--FENN-D | LLSQNIDVE----GI | 212 |
| KLJ37842 | 144 | DKKEKADLRLIYLALAHIIKFRGHFLIEDDsFDVRNTDISKQ--YQDFLEIFNTT--FENN-D | LLSQNVDVE----AI | 212 |
| KLJ72361 | 144 | DKKEKADLRLIYLALAHIIKFRGHFLIEDDsFDVRNTDISKQ--YQDFLEIFNTT--FENN-D | LLSQNIDVE----GI | 212 |
| KLL20707 | 144 | DKKEKADLRLIYLALAHIIKFRGHFLIEDDsFDVRNTDISKQ--YQDFLEIFNTT--FENN-D | LLSQNIDVE----AI | 212 |
| KLL42645 | 144 | DKKEKADLRLIYLALAHIIKFRGHFLIEDDsFDVRNTDISKQ--YQDFLEIFNTT--FENN-D | LLSQNVDVE----GI | 212 |
| WP_047207273 | 144 | DKKEKADLRLIYLALAHIIKFRGHFLIEDDsFDVRNTDIQKQ--YQAFLEIFDTT--FENN-D | LLSQNIDVE----AI | 212 |
| WP_047209694 | 144 | DKKEKADLRLIYLALAHIIKFRGHFLIEDDsFDVRNTDISKQ--YQAFLEIFDTT--FENN-D | LLSQNIDVE----AI | 212 |
| WP_050198062 | 144 | DKKEKADLRLIYLALAHIIKFRGHFLIEDDsFDVRNTDISKQ--YQDFLEIFNTT--FENN-D | LLSQNIDVE----AI | 212 |
| WP_050201642 | 144 | DKKEKADLRLIYLALAHIIKFRGHFLIEDDsFDVRNTDISKQ--YQDFLEIFNTT--FENN-D | LLSQNIDVE----GI | 212 |
| WP_050204027 | 144 | DKKEKANLRLIVYLALAHIIKFRGHFLIEDDsFDVRNTDIQRQ--YQAFLEIFDTT--FENN-H | LLSQNIDVE----GI | 212 |
| WP_050881965 | 144 | DKKEKADLRLIYLALAHIIKFRGHFLIEDDsFDVRNTDISKQ--YQDFLEIFNTT--FENN-D | LLSQNIDVE----AI | 212 |

```
                    -continued

WP_050886065    144  DKKEKADLRLIYIALAHIIKFRGHFLIEDDsFDVRNTDISKQ--YQDFLEIFNTT--FENN-D  LLSQNVDVE---AI  212
AHN30376        144  DKKEKADLRLIVYLALAHIIKFRGHFLIEDDrFDVRNTDIQKQ--YQAPLEIFDTS--FENN-H  LLSQNVDVE---AI  212
EA078426        144  DKKEKADLRLIVYLALAHIIKFRGHFLIEDDsFDVRNTDIQKQ--YQDFLEIFNTT--FENN-D  LLSQNVDVE---AI  212
CCW42055        144  DKKEKADLRLIVYLALAHIIKFRGHFLIEDDrFDVRNTDIQKQ--YQAFLEIFDTT--FENN-H  LLSQNVDVE---AI  212
WP_003041502    144  DISQKADLRLIVYLALAHMIKFRGHFLIEGQ-LKAENTNVQAL--FKDFVEVDKT--VEES-H  LSEITVDAL---SI  211
WP_037593752    144  NSKEKADLRLIVYLALAHMIKFRGHFLIEGD-LKAENTNVQAL--FKDFVEEYDKT--IEES-H  LSEITVDAL---SI  212
WP_049516684    145  DISQKADLRLIVYLALAHMIKFRGHFLIEGQ-LKAENTNVQAL--FKDFVEVDKT--VEES-H  LSEMTVDAL---SI  212
GAD46167        144  NSKEKADLRLIVYLALAHMIKFRGHFLIEGD-LKAENTNVQAL--FKDFVEEYDKT--IEES-H  LSEITVDAL---SI  211
WP_018363470    145  DSTEKADLRLIVYLALAHMIKFRGHFLIEGE-LNAENTDVQKL--FTDFVGVDRT--FDDS-H  LSEITVDAA---SI  212
WP_003043819    144  DSPEKADLRLIYLALAHMIKFRGHFLIEGK-LNAENSDVAKL--FYQLIQTYNQL--FEES--  LDEIEVDAK---GI  211
WP_006269658    144  DTSKKADLRLIYLALAHMIKFRGHFLYEGD-LKAENTDVQAL--FKDFVEEYDKT--IEES-H  LSEITVDAL---SI  211
WP_048800889    144  DSTGKVDLRLIVYLALAHMIKFRGHFLIEGQ-LKAENTDVQTL--FNDFVEVYDKT--IEES-H  LAEITVDAL---SI  211
WP_012767106    144  DSTDKADLRLIVYLALAHMIKFRGHFLIEGD-LNPDNSDMDKL--FIQLVQTYNQL--FEEN--  INASRVDAK---AI  211
WP_014612333    145  DSTDKADLRLIVYLALAHMIKFRGHFLIEGD-LNPDNSDVDKL--FIQLVQTYNQL--FEEK--  INASGVDAK---AI  211
WP_015017095    145  DSTDKADLRLIVYLALAHMIKFRGHFLIEGD-LNPDNSDMDKL--FIQLVQTYNQL--FEEN--  INASRVDAK---AI  211
WP_015057649    144  DSTDKADLRLIVYLALAHMIKFRGHFLIEGD-LNPDNSDMDKL--FIQLVQTYNQL--FEEN--  INASRVDAK---AI  211
WP_048327215    145  DSTDKADLRLIVYLALAHMIKFRGHFLIEGD-LNPDNSDMDKL--FIQLVQTYNQL--FEEN--  INASRVDAK---AI  211
WP_049519324    144  DSTDKADLRLIVYLALAHMIKFRGHFLIEGD-LNPDNSDVDKL--FIQLVQTYNQL--FEEN--  INASRVDAK---AI  211
WP_012515931    144  DNPQKADLRLIYLALAHMIKFRGHFLIEGT-LSSKNNNLQKS--FDHLVDTYNLL--FEEN--  LLTEGINAK---EL  211
WP_021320964    144  DNPQKADLRLIYLALAHMIKFRGHFLIEGT-LSSKNNNLQKS--FDHLVDTYNLL--FEEQ--  LLTEGINAK---EL  211
WP_037581760    144  DNPQKADLRLIYLALAVAHIIKFRGHFLIEGT-LSSKNNNLQKS--FDHLVDTYNLL--FEEQ--  LLTEGINAK---EL  211
WP_044232481    144  DSPEKVDLRLIVYLALAHMIKFRGHFLIEGQ-LNAENTDVQKI--FADFVGVDRT--FDDS-H  LSEITVDAA---SI  211
WP_009854540    144  DSSEKADLRLIVYLALAHMIKFRGHFLIEGK-LNAENTDVQKL--FTDFVGVDRT--FDDS-H  LSEITVDVA---ST  212
WP_012962174    145  DSHEKADLRLIVYLALAHMIKFRGHFLIEGK-LNAENTDVQKL--FEAFVEVDRT--FDDS-N  LSEITVDAS---SI  212
WP_039695303    145  DSSEKADLRLIVYLALAHMIKFRGHFLIEGE-LNAENTDVQKI--FADFVGVNRT--FDDS-H  LSEITVDVA---SI  212
WP_014334983    144  DSQEKADLRLIVYLALAHMIKFRGHFLIEGE-LNAENTDVQKI--FNVFVETVDKI--VDES-H  LSEIEVDAS---SI  212
WP_030099269    144  DSDQKADLRLIYLALAHMIKFRGHFLIEGN-LDSENTDVHVL--FLNLVNIYNNL--FEED--  VETASIDAE---KI  211
AHY15608        144  DSDQKADLRLIYLALAHMIKFRGHFLIEGN-LDSENTDVHVL--FLNLVNIYNNL--FEED--  VETASIDAE---KI  211
AHY17476        144  DSDQKADLRLIYLALAHMIKFRGHFLIEGN-LDSENTDVHVL--FLNLVNIYNNL--FEED--  VETASIDAE---KI  211
ESR09100        ---  -----------------------------------------------------------------  --------------  ---
AGM98575        144  DSDQKADLRLIYLALAHMIKFRGHFLIEGN-LDSENTDVHVL--FLNLVNIYNNL--FEED--  VETASIDAE---KI  211
ALF27331        144  DNPEKTDLRLIYLALAHMIKFRGHFLIEGN-LDSENTDVHVL--FLNLVNIYNNL--FEED--  LQEQNVQVE---KI  211
WP_018372492    144  DTPDKMDIRLIYLALAHMIKFRGHFLIEGD-LDIENIGIQDS--FKSFIEEYNTQ--FGTK--  -LDSTTKVE---AI  209
WP_045618028    145  DSKEKADFRLIYLALAHMIKFRGHFLYEES-FDIKNNDIQKI--FNEFISIYDNT--FEGS-S  LNGQNAQVE---AI  212
WP_045635197    144  DSKEKTDLRLIYLALAHMIKYRGHFLYEEA-FDIKNNDIQKI--FNEFISIYDNT--FEGS-S  LSGQNAQVE---AI  211
WP_002263549    144  DNPEKVDLRLIYLALAHMIKYRGHFLIEGK-FDTRNNDVQRL--FQEFLAVIDNT--FENS-S  LQEQNVQVE---EI  211
WP_002263887    144  DNPEKVDLRLIYLALAHMIKFRGHFLIEGK-FDTRNNDVQRL--FQEFLAVIDNT--FENS-S  LQEQNVQVE---EI  211
WP_002264920    144  DSTEKADLRLIYLALAHMIKFRGHFLIEGE-LNAENTDVQRL--FADFVGVDRT--FDDS-H  LSEITVDAS---SI  211
WP_002269043    144  DNPEKTDLRLIYLALAHMIKFRGHFLIEGK-FDTRNNDVQRL--FQEFLAVIDNT--FENS-S  LQEQNVQVE---EI  211
WP_002269448    144  DNPEKVDLRLIYLALAHMIKFRGHFLIEGK-FDTRNNDVQRL--FQEFLAVIDNT--FENS-S  LQEQNVQVE---EI  211
WP_002271977    144  DNPEKVDLRLIYLALAHMIKFRGHFLIEGK-FDTRNNDVQRL--FQEFLAVIDNT--FENS-S  LQEQNVQVE---EI  211
WP_002272766    144  DNPEKVDLRLIYLALAHMIKFRGHFLIEGK-FDTRNNDVQRL--FQEFLAVIDNT--FENS-S  LQEQNVQVE---EI  211
WP_002273241    144  DNPEKVDLRLIYLALAHMIKFRGHFLIEGK-FDTRNNDVQRL--FQEFLAVIDNT--FENS-S  LQEQNVQVE---EI  211
WP_002275430    144  DNPEKVDLRLIYLALAHMIKFRGHFLIEGK-FDTRNNDVQRL--FQEFLAVIDNT--FDDS-H  LQEQNVQVE---EI  211
WP_002276448    144  DNPEKVDLRLIYLALAHMIKFRGHFLIEGK-FDTRNNDVQRL--FADFVGVDRT--FDDS-H  LQEQNVQVE---EI  211
WP_002277050    144  DSTEKADLRLIYLALAHMIKFRGHFLIEGE-LNAENTDVQRL--FADFVGVDRT--FDDS-H  LSEITVDAS---SI  211
WP_002773364    144  DNPEKTDLRLIYLALAHMIKFRGHFLIEGK-FDTRNNDVQRL--FQEFLAVIDNT--FENS-S  LQEQNVQVE---EI  211
WP_002779025    144  DNPEKVDLRLIYLALAHMIKFRGHFLIEGK-FDTRNNDVQRL--FQEFLAVIDNT--FENS-S  LQEQNVQVE---EI  211
WP_002779859    144  DSTEKADLRLIYLALAHMIKFRGHFLIEGE-LNAENTDVQKL--FADFVGVDRT--FDDS-H  LSEITVDAS---SI  211
WP_002280230    144  DNPEKVDLRLIYLALAHMIKFRGHFLIEGK-FDTRNNDVQRL--FQEFLAVIDNT--FENS-S  LQEQNVQVE---EI  211
WP_002281696    144  DNPEKVDLRLIYLALAHMIKFRGHFLIEGK-FDTRNNDVQRL--FQEFLAVIDNT--FENS-S  LQEQNVQVE---EI  211
WP_002282247    144  DSTEKADLRLIYLALAHMIKFRGHFLIEGE-LNAENTDVQRL--FADFVGVDRT--FDDS-H  LSEITVDAS---SI  211
WP_002282906    144  DNPEKVDLRLIYLALAHMIKFRGHFLIEGK-FDTRNNDVQRL--FQEFLAVIDNT--FENS-S  LQEQNVQVE---EI  211
```

-continued

| ID | | | | |
|---|---|---|---|---|
| WP_002283846 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002287255 | 144 | DNPEKVDLRLIVYLALAHIIKFRGHFLIEGK-FDTRNNDVQRL--FQEFLAVYDNT--FENS-S | LQEQNVQVE---EI | 211 |
| WP_002288990 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002289641 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002290427 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002295753 | 144 | DNPEKVDLRLIVYLALAHIIKFRGHFLIEGK-FDTRNNDVQRL--FQEFLAVYDNT--FENS-S | LQEQNVQVE---EI | 211 |
| WP_002296423 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002304487 | 144 | NSTEKADLRLIVYLSLAHHMKFRGHFLIEGQ-LKAENTNVQAL--FKDFVEVYDKT--VEES-H | LSEMTVDAL---SI | 211 |
| WP_002305844 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002307203 | 144 | DNPEKTDLRLIVYLALAHIIKFRGHFLIEGK-FDTRNNDVQRL--FQEFLAVYDNT--FENS-S | LQEQNVQVE---EI | 211 |
| WP_002310390 | 144 | DNPEKTDLRLIVYLALAHIIKFRGHFLIEGK-FDTRNNDVQKL--FQEFLAVYDNT--FENS-S | LQEQNVQVE---EI | 211 |
| WP_002352408 | 144 | DNPEKTDLRLIVYLALAHIIKFRGHFLIEGK-FDTRNNDVQRL--FQEFLAVYDNT--FENS-S | LQEQNVQVE---EI | 211 |
| WP_012997688 | 144 | DNPEKVDLRLIVYLALAHIIKFRGHFLIEGK-FDTRNNDVQRL--FQEFLAVYDNT--FENS-S | LQEQNVQVE---EI | 211 |
| WP_014677909 | 144 | DNPEKTDLRLIVYLALAHIIKFRGHFLIEGK-FDTRNNDVQRL--FQEFLAVYDNT--FENS-S | LQEQNVQVE---EI | 211 |
| WP_019312892 | 144 | DNPEKVDLRLIVYLALAHIIKFRGHFLIEGK-FDTRNNDVQRL--FQEFLAVYDNT--FENS-S | LQEQNVQVE---EI | 211 |
| WP_019313659 | 144 | DNPEKTDLRLIVYLALAHIIKFRGHFLIEGK-FDTRNNDVQRL--FQEFLAVYDNT--FENS-S | LQEQNVQVE---EI | 211 |
| WP_019314093 | 144 | DNPEKTDLRLIVYLALAHIIKFRGHFLIEGK-FDTRNNDVQRL--FQEFLAVYDNT--FENS-S | LQEQNVQVE---EI | 211 |
| WP_019315370 | 144 | DNPEKTDLRLIVYLALAHIIKFRGHFLIEGK-FDTRNNDVQRL--FQEFLAVYDNT--FENS-S | LQEQNVQVE---EI | 211 |
| WP_019803776 | 144 | DNPEKTDLRLIVYLALAHIIKFRGHFLIEGK-FDTRNNDVQRL--FQEFLAVYDNT--FENS-S | LQEQNVQVE---EI | 211 |
| WP_019805234 | 144 | DNPEKTDLRLIVYLALAHIIKFRGHFLIEGK-FDTRNNDVQRL--FQEFLAVYDNT--FENS-S | LQEQNVQVE---EI | 211 |
| WP_024783594 | 144 | DSTEKADLRLVYLALAHIIKFRGHFLIEGE-LNAENTDVQKL--FADFVGVYDRT--FDDS-H | LSEITVDAS---SI | 211 |
| WP_024784288 | 144 | DNPEKVDLRLIVYLALAHIIKFRGHFLIEGK-FDTRNNDVQRL--FQEFLAVYDNT--FENS-S | LQEQNVQVE---EI | 211 |
| WP_024784666 | 144 | DNPEKTDLRLIVYLALAHIIKFRGHFLIEGK-FDTRNNDVQRL--FQEFLAVYDNT--FENS-S | LQEQNVQVE---EI | 211 |
| WP_024784894 | 144 | DSTEKADLRLVYLALAHIIKFRGHFLIEGE-LNAENTDVQKL--FADFVGVYDRT--FDDS-H | LSEITVDAS---SI | 211 |
| WP_024786433 | 144 | DNPEKTDLRLIVYLALAHIIKFRGHFLIEGK-FDTRNNDVQRL--FQEFLAVYDNT--FENS-S | LQEQNVQVE---EI | 211 |
| WP_049473442 | 144 | DNPEKTDLRLIVYLALAHIIKFRGHFLIEGK-FDTRNNDVQRL--FQEFLAVYDNT--FENS-S | LQEQNVQVE---EI | 211 |
| WP_049474547 | 137 | DNPEKTDLRLIVYLALAHIIKFRGHFLIEGK-FDTRNNDVQRL--FQEFLAVYDNT--FENS-S | LQEQNVQVE---EI | 204 |
| EMC03581 | 145 | DSKEKTDLRLIYLALAHMIKFRGHFLYEDT-FDIKNNDIQKI--FNEFISIYNNT--FEGN-S | LSGQNVQVE---AI | 212 |
| WP_000428612 | 145 | DSKEKTDLRLIIYLALAHMIKYRGHFLYEDT-FDIKNNDIQKI--FSEFISIYDNT--FEGS-S | LSGQNAQVE---AI | 212 |
| WP_000428613 | 145 | DSKEKVDLRLIIYLALAHMIKYRGHFLYEEA-FDIKNNDIQKI--FNEFTILYDNT--FEES-S | LSKGNAQVE---EI | 211 |
| WP_049523028 | 113 | DSDEKADLRLIYLALAHMIKFRGHFLIEGE-LDSQNTDVNAL--FLKLVDTVNLM--FEDD-- | IDTQTIDAT---VI | 180 |
| WP_003107102 | 146 | DNTEKADLRLIYLALAHIIKFRGHFLIEGA-LSANNTDVQQL--VHAIVDAYNIM--FEED-- | LDIEAIDVK---AI | 213 |
| WP_054279288 | 145 | DSKEKADLRLIYLALAHMIKFRGHFLYEES-FDIKNNDIQKI--FNEFISIYDNT--FEGS-S | LSGQNAQVE---AI | 212 |
| WP_049531101 | 145 | DSKEKADLRLIYLALAHMIKYRGHFLYEEA-FDIKNNDIQKI--FNEFINIYDNT--FEGS-S | LSGQNEQVE---AI | 212 |
| WP_049538452 | 145 | DSKEKADLRLIVLALAHMIKYRGHFLYEEA-FDIKNNDIQKI--FNEFINIYDNT--FEGS-S | LSGQNAQVE---TI | 212 |
| WP_049549711 | 145 | DSSQKADLRLIYLALAHMIKYRGHELFIEGD-LKSENKDVQHL--FNDEVEMFDKT--VEGS-Y | LSENLPNVA---DV | 212 |
| WP_007896501 | 146 | DRDQKADLRLIYLALAHMIKYRGHFLIEGK-LNSENTDVQKL--FIALVTVYNLL--FEEE-- | IAGETCDAK---AL | 213 |
| EFR44625 | 98 | DRDQKADLRLIYLALSHIIKERGHFLYEDQt FTTDGNQLQHH--FKEFLLAFDGI--QVDC-Y | IAGETCDAK---AL | 165 |
| WP_002897477 | 144 | DSKEKSDVRLIYLALAHHVIKYRGNFLYEGQkFNMDASNIEDK--LSDIFTQFTSFnnIPYEdD | LASKHTDIS---GI | 211 |
| WP_002906454 | 144 | DSKEKTDLRLIYLALAHMIKFRGHFLYEET-FDIKNNDIQKI--FSEFISIYDNT--FEGK-S | LSGQNAQVE---AI | 211 |
| WP_009729476 | 145 | DSKEKTDLRLIYLALAHMIKYRGHFLYEEA-FDIKNNDIQKI--FNEFISIYNNT--FEGN-Y | LSGQNAQVE---AI | 212 |
| CQR24647 | 144 | DSSEKADLRLIYLALAHMIKYRGHFLIDEP-IDIRNMNSQNL--FKEFLLAFDGI--QVDC-Y | LASKHTDIS---GI | 211 |
| WP_000066813 | 145 | DSKEKTDLRLIYLALAHMIKYRGHFLYEEA-FDIKNNDIQKI--FSEFISIYDNT--FEGK-S | LSGQNAQVE---AI | 212 |
| WP_009754323 | 145 | DSKEKADLRLIYLALAHMIKYRGHFLYEEA-FDIKNNDIQKI--FNEFINIYDNT--FEGS-S | LSGQNAQVE---AI | 212 |
| WP_044674937 | 144 | DSSQKADLRLIYLALAHMIKYRGHELFIEGD-LKSENKDVQHL--FNDEVEMFDKT--VEGS-Y | LSENLPNVA---DV | 211 |
| WP_044767715 | 144 | DSSQKADLRLIYLALAHMIKYRGHELFEGD-LKSENKDVQHL--FNDEVEMFDKT--VEGS-Y | LSENLPNVA---DV | 211 |
| WP_044680361 | 144 | DSSQKADIRLIYLALAHMIKYRGHELFEGD-LKSENKDVQHL--FNDEVEMFDKT--VEGS-Y | LSENLPNVA---DV | 211 |
| WP_044681799 | 144 | DSSQKADLRLIYLALAHMIKYRGHELFEGD-LKPDNSDVDKL--FIQLVQTYNQL--FEEN-- | LSENLPNVA---SI | 211 |
| WP_049533112 | 144 | DISQKADLRLIYLALAHMIKYRGHFLIEGD-LKAENTNVQAL--FKDEVEVYDKT--VEES-H | LSEMTVDAL---SI | 211 |
| WP_029090905 | 101 | SQHRQFDIREVYLAIHHLIKYRGNFLYEGQtFTTDGNQLQHH--IKAIITMINSTl--NR-- | IIPETIDINvfeKI | 171 |
| WP_006506696 | 140 | ESTEKADLRLIYLALHHIVKYRGNFLYEGQkFNMDASNIEDK--LSDIFTQFTSFnnIPYEdD | --KKNLEIL---EI | 210 |
| AIT42264 | 140 | DSTDKADLRLIYLALAHMIKERGHFLIEGD-LNPDNSDVDKL--FIQLVQTYNQL--FEEN-- | INASGVDAK---AI | 211 |
| WP_034440723 | 143 | DSNQKADLRLIYLALAHMIKYRGHFLIEGD-LKMDGISISES--FQEFIDSYNEVcaLEDE-N | NDELLTQIE---NI | 217 |

-continued

```
AKQ21048         144 DSTDKADLRLIYLALAHMIKERGHFLIEGD-LNPDNSDVDKL--FIQLVQTNQL--FEEN- INASGVDAK---AI 211
WP_004636532     144 DNPEKADLRLIVYTALAHIVKYRGHFLIEGE-LNTENTSISET--FEQFLDTYSDI-FKEQ- LVGDISKVE---EI 210
WP_002364836     144 DSSEQADLRLIYLALAHIVKYRGHFLIEGK-LSTENISVKEQ--FQQFMIIYNQT-FVNGeS PLPESVLIE---EE 217
WP_016631044      95 DSSEQADLRLIYLALAHIVKYRGHFLIEGK-LSTENISVKDQ--FQQFMIIYNQT-FVNGeS PLPESVLIE---EE 168
EMS75795             ---------------------------------------------------------- ---------------
WP_002373311     144 DSSEQADLRLIYLALAHIVKYRGHFLIEGK-LSTENTSVKEQ--FQQFMIIYNQT-FVNGeS PLPESVLIE---EE 217
WP_002378009     144 DSSEQADLRLIYLALAHIVKYRGHFLIEGK-LSTENISVKEQ--FQQFMIIYNQT-FVNGeS PLPESVLIE---EE 217
WP_002407324     144 DSSEQADLRLIYLALAHIVKYRGHFLIEGK-LSTENISVKEQ--FQQFMIIYNQT-FVNGeS PLPESVLIE---EE 217
WP_002413717     144 DSSEQADLRLIYLALAHIVKYRGHFLIEGK-LSTENISVKEQ--FQQFMIIYNQT-FVNGeS PLPESVLIE---EE 217
WP_010775580     144 DSSEQADLRLIYLALAHIVKYRGHFLIEGK-LSTENISVKEQ--FQQFMIIYNQT-FVNGeS PLPESVLIE---EE 217
WP_010818269     144 DSSEQADLRLIYLALAHIVKYRGHFLIEGK-LSTENISVKEQ--FQQFMIIYNQT-FVNGeS PLPESVLIE---EE 217
WP_010824395     144 DSSEQADLRLIYLALAHIVKYRGHFLIEGK-LSTENTSVKDQ--FQQFMVIYNQT-FVNGeS PLPESVLIE---EE 217
WP_016622645     144 DSSEQADLRLIYLALAHIVKYRGHFLIEGK-LSTENISVKEK--FQQFMVIYNQT-FVNGeS PLPESVLIE---EE 217
WP_033624816     144 DSSEQADLRLIYLALAHIVKYRGHFLIEGK-LSTENISVKDQ--FQQFMVIYNQT-FVNGeS PLPESVLIE---EE 217
WP_033625576     144 DSSEQADLRLIYLALAHIVKYRGHFLIEGK-LSTENISVKEQ--FQQFMIIYNQT-FVNGeS PLPESVLIE---EE 217
WP_037891179     144 DSSEQADLRLIYLALAHIVKYRGHFLIEGK-LSTENISVKDQ--FQQFMIIYNQT-FVNGeS PLPESVLIE---EE 217
WP_002310644     144 DSSEKADIRLIVYLAMAHLLKYRGHFLIEGE-LNTENSSVTET--FRQFLSTNQQ--FSEA-D KLDEAVDCS---FV 216
WP_002312694     144 DSSEKADIRLVYLAMAHLLKYRGHFLIEGE-LNTENSSVTET--FRQFLSTNQQ--FSEA-G KLDEAVDCS---FV 216
WP_002314015     144 DSSEKADIRLVYLAMAHLLKYRGHFLIEGE-LNTENSSVTET--FRQFLSTNQQ--FSEA-D KLDEAVDCS---FV 216
WP_002320716     144 DSSEKADIRLVYLAMAHLLKYRGHFLIEGE-LNTENSSVTET--FRQFLSTNQQ--FSEA-D KLDEAVDCS---FV 216
WP_002330729     144 DSSEKADIRLVYLAMAHLLKYRGHFLIEGE-LNTENSSVTET--FRQFLSTNQQ--FSEA-D KLDEAVDCS---FV 216
WP_002335161     144 DSSEKADIRLVYLAMAHLLKYRGHFLIEGE-LNTENSSVTET--FRQFLSTNQQ--FSEA-D KLDEAVDCS---FV 216
WP_002345439     144 DSTEKEDLRLIVYLAMAHLLKYRGHFLFEGD-LDTENTSIEES--FRVFLEQYSKQ--SDQP- LIVHQPVL---TI 209
WP_047937432     144 DSSEKADIRLVYLAMAHLLKYRGHFLIEGE-LNTENSSVTET--FRQFLSTNQQ--FSEA-D KLDEAVDCS---FV 216
WP_010720994     144 DSTEKGDLRLIVYLAMAHLLKYRGHFLFEGD-LDTENTSIEES--FRVFLEQYGKQ--SDQP- LIVHQPVL---TI 209
WP_010737004     144 DSTEKEDPRLIVYLALHHIVKYRGNFLIYEGQkFSMDVSNIEDK--MIDVLRQFNEInIFEYVeD --KKIDEVL---NV 215
WP_010737004     144 DSTEKEDPRLIVYLALHHIVKYRGNFLIYEGQkFSMDVSNIEDK--MIDVLRQFNEInIFEYVeD --KKIDEVL---NV 215
WP_034700478     144 DSTEKADIRLVYLAMAHLLKYRGHFLIEES--FRVFLEQYSKQ--SDQP- LIVHQPVL---TI 209
WP_007209003     144 DGDEKADLRVVYLAMAHILKYRGNELLEGE-IDLRTTDINKV-FAEFSETLNEN--SDENlG FIDESIDFS---EV 214
WP_023519017     144 NSKEQADIRLVVYLALHIIKYRCLKYRGHFLEGE-LDTENTSVTEN--YQQFLQAYQQF-FPEP- IGDLDDAV---PI 209
WP_010770040     144 DTSEQADLRLIVYLALAHIIKYRGHFLIEGE-LNTENSSVSET--FRTFPIQVVNQI-FRENe PLAVPDNIE---EL 212
WP_048604708     144 DAEEKADLRLVYLAMAHIIKYRGHFLFEGE-LDTENTSEET--FKTFLQKNQT--FN PVDETISIG---SI 208
WP_010750235     144 DSTEKADIRLVYLALAHIMKFRGHFLFEGE-LDTENTVEET--FKEFIDIYNEQ--FEEG- IIFYKDIP---LI 209
AII16583         183 DSTDKADLRLIYLALAHMIKERGHFLIEGD-LNPDNSDVDKL--FIQLVQTNQL--FEEN- INASGVDAK---AI 250
WP_029073316     145 ESKEKEDPRLIYLALHHIVKYRGNFLYEGQkFSMDVSNIEDK--MIDVLRQFNEInIFEYVeD --KKIDEVL---NV 215
WP_031589969     145 ESKEKEDPRLIYLALHHIVKYRGNFLYEGQkFSMDVSNIEDK--MIDVLRQFNEInIFEYVeD --KKIDEVL---NV 215
KDA45870         145 NNDRPADDLRLVYLALAHIIKYRGNELLEGE-IDLRTTDINKV-FAEFSETLNEN--SDENlG ---KLDVA---DI 209
WP_039099354     133 TEKRQFDIREIYLAMHHIVKYRGHFLNEAPvSSEKSSEINLVahFDRLNTIFADL--SEESgF -TDKLAEVK---AL 206
AKP02966         138 INKNKADIRLVLALHNIIKYRGNFTYEHQkFNISTLNSNLS--KELIELNQQLiKYDIS- -FPDNCDWNhisDI 208
WP_010991369     144 NSSEKADILIRVYLALAHIIKYRGNFLIEGA-LDTQNTSVDGI--YKQFIQTNQV--FASGiE KLEDNKDVA---KI 217
WP_033838504     144 NSSEKADLRLVYLALAHIIKYRGNFLIEGA-LDTQNTSVDGI--YKQFIQTNQV--FASGiE KLEDNKDVA---KI 217
EHN60060         147 NSSEKADLRLVYLALAHIIKYRGNFLIEGA-LDTQNTSVDGI--YKQFIQTNQV--FASGiE KLEDNKDVA---KI 220
WP_038409211     144 NSSDKADLRLVYLALAHIIKYRGNFLIEGM-LDTKNTSVDEV--FKQFIQTNQI--FASDiE RLEENKEVA---EI 217
EFR95520             ---------------------------------------------------------- ---------------
WP_003723650     144 NSSEKADLRLVYLALAHIIKYRGNFLIEGA-LDTKNTSVDEV--YKQFIQTNQV--FMSNiE KVEENIEVA---NI 217
WP_003727705     144 NSSEKADLRLVYLALAHIIKYRGNFLIEGA-LDTKNTSVDEV--YKQFIQTNQV--FMSNiE KVEENTEVA---SI 217
WP_003730785     144 NSSEKADLRLVYLALAHIIKYRGNFLIEGA-LDTKNTSVDEV--YKQFIQTNQV--FMSNiE KVEENTEVA---NI 217
WP_003733029     144 DSQKKADLRLVYLALAHIIKYRGNFLIEGA-LDTKNTSIDEM--FKQFLQINQV--FANDiE KTEKNQEVA---QI 217
WP_003739838     144 NSSEKADLRLVYLALAHIIKYRGNFLIEGA-LDTKNTSVDGV--YKQFIQTNQV--FISNiE KMEENTTVA---DI 217
WP_014601172     144 NSSEKADLRLVYLALAHIIKYRGNFLIEGA-LDTKNTSVDGV--YEQFIQTNQV--FMSNiE KVEENIEVA---NI 217
WP_023548323     144 NSSEKADLRLVYLALAHIIKYRGNFLIEGA-LDTKNTSVDGV--YEQFILTNQV--FMSNiE KVEENIEVA---NI 217
WP_031665337     144 NSSEKADLRLVYLALAHIIKYRGNFLIEGA-LDTKNTSVDGV--YEQFIQTNQV--FMSNiE KVEENIEVA---NI 217
```

-continued

```
WP_031669209   144 DSQKKADLRLVYLALAHIIKYRGHFLIEGA-LDTKNTSIDEM--FKQFLQIYNQV--FANDiE  KTEKNQEVA---QI  217
WP_033920898   144 NSSEKADLRLVYLALAHIIKYRGNFLIEGA-LDTKNTSVDGV--YEQFIQTYNQV--FMSNiE  KVEENIEVA---NI  217
AKI42028       147 NSSEKADLRLVYLALAHIIKYRGNFLIEGA-LDTKNTSVDGV--YEQFIQTYNQV--FMSNiE  KVEENIEVA---NI  220
AKI50529       147 NSSEKADLRLVYLALAHIIKYRGNFLIEGA-LDTKNTSVDGV--YEQFIQTYNQV--FMSNiE  KVEENIEVA---NI  220
EFR83390       144 NSSDKADLRLVYLALAHIIKYRGNFLIEGK-LDTKNTSVDEV--FKQFIKTYNQV--FASDiE                  217
AKE81011       160 DSTDKADLRLIYLALAHMIKFRGHFLIEGD-LNPDNSDVDKL--FIQLVQTYNQL--FEEN-  RIEENNEVA---KI  227
CU082355       144 ESTEKADPRLIYLALHHIVKYRGNFLYEGQkFNMDASNIEDK--LSDVFTQFADFmnIPYEdD  --KKNLEIL---EI  214
WP_033162887   145 ENKEKADPRLIYLALHHIVKYRGNFLYEGQsFTMDNSDIEER--LNSAIEKFMSIneFDNRiV  --SDINSMI---AV  215
AGZ01981       177 DSTDKADLRLIYLALAHMKFRGHFLIEGD-LNPDNSDVDKL--FIQLVQTYNQL--FEEN-  INASGVDAK---AI  244
AKA60242       144 DSTDKADLRLIYLALAHMKFRGHFLIEGD-LNPDNSDVDKL--FIQLVQTYNQL--FEEN-  INASGVDAK---AI  211
AKS40380       144 DSTDKADLRLIYLALAHMKFRGHFLIEGD-LNPDNSDVDKL--FIQLVQTYNQL--FEEN-  INASGVDAK---AI  211
4UN5_B         148 DSTDKADLRLIYLALAHMKFRGHFLIEGD-LNPDNSDVDKL--FIQLVQTYNQL--FEEN-  INASGVDAK---AI  215

WP_010922251   212 LSAR-LSKSRRLENLIAQ-L-PG              EKKNGLFGNLIALSLGLTPNFKSNF--DLAED-A---KLQ--LSKDTYDDDLDN  277

WP_039695303   213 LTEK-ISKSRRLENLIKY-Y-PT              EKSTGLFSEFLKLIVGNQADFKKHF--DLEDK-A---PLQ--FSKDTYEEDLEE  278
WP_045635197   212 FTDK-ISKSAKRERVLKL-F-PD              EKSTGLFSEFLKLIVGNQADFKKHF--DLEDK-A---PLQ--FSKDTYDEDLEN  277
5AXW_A         135 LSTK---EQISRN-S--K                   -------LEEKyVa-ELQ-                                    157
WP_009880683                                                                                                
WP_010922251   212 LSAR-LSKSRRLENLIAQ-L-PG              EKKNGLFGNLIALSLGLTPNFKSNF--DLAED-A---KLQ--LSKDTYDDDLDN  277
WP_011054416   212 LSAR-LSKSRRLENLIAQ-L-PG              EKKNGLFGNLIALSLGLTPNFKSNF--DLAED-A---KLQ--LSKDTYDDDLDN  277
WP_011284745   212 LSAR-LSKSRRLENLIAQ-L-PG              EKKNGLFGNLIALSLGLTPNFKSNF--DLAED-A---KLQ--LSKDTYDDDLDN  277
WP_011285506   212 LSAR-LSKSRRLENLIAQ-L-PG              EKKNGLFGNLIALSLGLTPNFKSNF--DLAED-A---KLQ--LSKDTYDDDLDN  277
WP_011527619   212 LSAR-LSKSRRLENLIAQ-L-PG              EKKNGLFGNLIALSLGLTPNFKSNF--DLAED-A---KLQ--LSKDTYDDDLDN  277
WP_012560673   212 LSAR-LSKSRRLENLIAQ-L-PG              EKKNGLFGNLIALSLGLTPNFKSNF--DLAED-A---KLQ--LSKDTYDDDLDN  277
WP_014407541   212 LSAR-LSKSRRLENLIAQ-L-PG              EKKNGLFGNLIALSLGLTPNFKSNF--DLAED-A---KLQ--LSKDTYDDDLDN  277
WP_020905136   212 LSAR-LSKSRRLENLIAQ-L-PG              EKRNGLFGNLIALSLGLTPNFKSNF--DLAED-A---KLQ--LSKDTYDDDLDN  277
WP_023080005   212 LSAR-LSKSRRLENLIAQ-L-PG              EKRNGLFGNLIALSLGLTPNFKSNF--DLAED-A---KLQ--LSKDTYDDDLDN  277
WP_023610282   212 LSAR-LSKSRRLENLIAQ-L-PG              EKKNGLFGNLIALSLGLTPNFKSNF--DLAED-A---KLQ--LSKDTYDDDLDN  277
WP_030125963   212 LSAR-LSKSRRLENLIAQ-L-PG              EKKNGLFGNLIALSLGLTPNFKSNF--DLAED-A---KLQ--LSKDTYDDDLDN  277
WP_030126706   212 LSAR-LSKSRRLENLIAQ-L-PG              EKKNGLFGNLIALSLGLTPNFKSNF--DLAED-A---KLQ--LSKDTYDDDLDN  277
WP_031488318   212 LSAR-LSKSRRLENLIAQ-L-PG              EKKNGLFGNLIALSLGLTPNFKSNF--DLAED-A---KLQ--LSKDTYDDDLDN  277
WP_032460140   212 LSAR-LSKSRRLENLIAQ-L-PG              EKKNGLFGNLIALSLGLTPNFKSNF--DLAED-A---KLQ--LSKDTYDDDLDN  277
WP_032461047   212 LSAR-LSKSRRLENLIAQ-L-PG              EKKNGLFGNLIALSLGLTPNFKSNF--DLAED-A---KLQ--LSKDTYDDDLDN  277
WP_032462016   212 LSAR-LSKSRRLENLIAQ-L-PG              EKKNGLFGNLIALSLGLTPNFKSNF--DLAED-A---KLQ--LSKDTYDDDLDN  277
WP_032462936   212 LSAR-LSKSRRLENLIAQ-L-PG              EKKNGLFGNLIALLGLTPNFKSNF--DLAED-A---KLQ--LSKDTYDDDLDN  277
WP_032464890   212 LSAR-LSKSRRLENLIAQ-L-PG              EKKNGLFGNLIALSLGLTPNFKSNF--DLAED-A---KLQ--LSKDTYDDDLDN  277
WP_033888930   37  LSAR-LSKSRRLENLIAQ-L-PG              EKKNGLFGNLIALSLGLTPNFKSNF--DLAED-A---KLQ--LSKDTYDDDLDN  102
WP_038431314   212 LSAR-LSKSRRLENLIAQ-L-PG              EKKNGLFGNLIALSLGLTPNFKSNF--DLAED-T---KLQ--LSKDTYDDDLDN  277
WP_038432938   212 LSAR-LSKSRRLENLIAQ-L-PG              EKKNGLFGNLIALSLGLTPNFKSNF--DLAED-A---KLQ--LSKDTYDDDLDN  277
WP_038434062   123                                                                                        188
BAQ51233                                                                                                     
KGE60162                                                                                                     
KGE60856       212 LSAR-LSKSRRLENLIAQ-L-PG              EKKNGLFGNLIALSLGLTPNFKSNF--DLAED-A---KLQ--LSKDTYDDDLDN  277
WP_002989955   212 LTEK-VSKSRRLENLIAH-Y-PA              EKKNTLFGNLIALGLQPNFKSNF--QLSED-A---KLQ--FSKDTYEEDLEG  277
WP_003030002   215 LTEK-ISKSRRLENLIKY-Y-PT              EKKNTLFGNLIALGLQPNFKMNF--KLSED-A---KLQ--FSKDSYEEDLGE  280
WP_003065552   213 LTDK-ISKSAKKDRILAQ-Y-PN              QKSTGIFAEFLKLIVGNQADFKKHF--NLEDK-T---PLQ--FAKDSYDEDLEN  278
WP_001040076   213 LTDK-ISKSAKKDRILAQ-Y-PN              QKSTGIFAEFLKLIVGNQADFKKHF--NLEDK-T---PLQ--FAKDSYDEDLEN  278
WP_001040078   213 LTDK-ISKSAKKDRILAQ-Y-PN              QKSTGIFAEFLKLIVGNQADFKKYF--NLEDK-T---PLQ--FAKDSYDEDLEN  278
WP_001040080   213 LTDK-ISKSAKKDRILAQ-Y-PN              QKSTGIFAEFLKLIVGNQADFKKYF--NLEDK-T---PLQ--FAKDSYDEDLEN  278
WP_001040081                                                                                                
```

-continued

| | | | | |
|---|---|---|---|---|
| WP_001040083 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040085 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040087 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040088 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040089 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040090 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040091 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040092 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040094 | 213 | LTDK-ISKSAKKDRILAR-Y-PN | QKSTGIFAEFLKLIVGNQADFKKYF-NLEDK-T---PLQ--FAKDSYDEDLEN | 278 |
| WP_001040095 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040096 | 213 | LTDK-ISKSAKKDRILAR-Y-PN | QKSTGIFAEFLKLIVGNQADFKKHF-NLEDK-T---PLQ--FAKDSYDEDLEN | 278 |
| WP_001040097 | 213 | LTDK-ISKSAKKDRILAR-Y-PN | QKSTGIFAEFLKLIVGNQADFKKHF-NLEDK-T---PLQ--FAKDSYDEDLEN | 278 |
| WP_001040098 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040099 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040100 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040104 | 213 | LTDK-ISKSAKKDRILAR-Y-PN | QKSTGIFAEFLKLIVGNQADFKKHF-NLEDK-T---PLQ--FAKDSYDEDLEN | 278 |
| WP_001040105 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040106 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040107 | 213 | LTDK-ISKSAKKDRILAR-Y-PN | QKSTGIFAEFLKLIVGNQADFKKHF-NLEDK-T---PLQ--FAKDSYDEDLEN | 278 |
| WP_001040108 | 213 | LTDK-ISKSAKKDRILAQ-Y-PN | QKSTGIFAEFLKLIVGNQADFKKHF-NLEDK-T---PLQ--FAKDSYDEDLEN | 278 |
| WP_001040109 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_001040110 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_015058523 | 213 | LTDK-ISKSAKKDRILAR-Y-PN | QKSTGIFAEFLKLIVGNQADFKKYF-NLEDK-T---PLQ--FAKDSYDEDLEN | 278 |
| WP_017643650 | 213 | LTDK-ISKSAKKDRILAR-Y-PN | QKSTGIFAEFLKLIVGNQADFKKHF-NLEDK-T---PLQ--FAKDSYDEDLEN | 278 |
| WP_017647151 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_017648376 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_017649527 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_017771611 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_017771984 | 213 | LTDK-ISKSAKKDRILAQ-Y-PN | QKSTGIFAEFLKLIVGNQADFKKYF-NLEDK-T---PLQ--FAKDSYDEDLEN | 278 |
| CFQ25032 | 213 | LTDK-ISKSAKKDRILAQ-Y-PN | QKSTGIFAEFLKLIVGNQADFKKYF-NLEDK-T---PLQ--FAKDSYDEDLEN | 278 |
| CFV16040 | 213 | LTDK-ISKSAKKDRILAQ-Y-PN | QKSTGIFAEFLKLIVGNQADFKKYF-NLEDK-T---PLQ--FAKDSYDEDLEN | 278 |
| KLJ37842 | 213 | LTDK-ISKSAKKDRILAQ-Y-PN | QKSTGIFAEFLKLIVGNQADFKKYF-NLEDK-T---PLQ--FAKDSYDEDLEN | 278 |
| KLJ72361 | 213 | LTDK-ISKSAKKDRILAQ-Y-PN | QKSTGIFAEFLKLIVGNQADFKKYF-NLEDK-T---PLQ--FAKDSYDEDLEN | 278 |
| KLL20707 | 213 | LTDK-ISKSAKKDRILAQ-Y-PN | QKSTGIFAEFLKLIVGNQADFKKYF-NLEDK-T---PLQ--FAKDSYDEDLEN | 278 |
| KLL42645 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_047207273 | 213 | LTDK-ISKSAKKDRILAR-Y-PN | QKSTGIFAEFLKLIVGNQADFKKYF-NLEDK-T---PLQ--FAKDSYDEDLEN | 278 |
| WP_047209694 | 213 | LTDK-ISKSAKKDRILAR-Y-PN | QKSTGIFAEFLKLIVGNQADFKKYF-NLEDK-T---PLQ--FAKDSYDEDLEN | 278 |
| WP_050198062 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_050201642 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_050204027 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_050881965 | 213 | LTDK-ISKSAKKDRILAQ-Y-PN | QKSTGIFAEFLKLIVGNQADFKKYF-NLEDK-T---PLQ--FAKDSYDEDLEN | 278 |
| WP_050886065 | 213 | LTDK-ISKSAKKDRILAQ-Y-PN | QKSTGIFAEFLKLIVGNQADFKKYF-NLEDK-T---PLQ--FAKDSYDEDLEN | 278 |
| AHN30376 | 213 | LTDK-ISKSAKKDRILAQ-Y-PN | QKSTGIFAEFLKLIVGNQADFKKYF-NLEDK-T---PLQ--FAKDSYDEDLEN | 278 |
| EA078426 | 213 | LTDK-ISKSAKKDRILAQ-Y-PN | QKSTGIFAEFLKLIVGNQADFKKYF-NLEDK-T---PLQ--FAKDSYDEDLEN | 278 |
| CCW42055 | 213 | LTDK-ISKSAKKDRILAQ-Y-PD | QKSTGIFAEFLKLIVGNQADFKKYF-NLEDK-T---PLQ--FAKDSYDEDLEN | 278 |
| WP_003041502 | 212 | LTEK-VSKSRRLENLIAH-Y-PA | EKKNTLFGNLIALFLGLQPNFKTNF-QLSED-A---KLQ--FSKDTYEEDLEG | 278 |
| WP_037593752 | 213 | LTEK-VSKSSRLENLIAH-Y-PT | EKKNTLFGNLIALSLGLQPNFKTNF-QLSED-A---KLQ--FSKDTYEEDLEG | 278 |
| WP_049516684 | 212 | LTEK-VSKSSRLENLVEC-Y-PT | EKKNTLFGNLIALSLGLQPNFKTNF-QLSED-A---KLQ--FSKDTYEEDLEE | 278 |
| GAD46167 | 212 | LTEK-VSKSSRLENLIAH-Y-PT | EKKNTLFGNLIALSLGLQPNFKTNF-QLSED-A---KLQ--FSKDTYEEDLEE | 277 |
| WP_018363470 | 213 | LTEK-ISKSRRLENLINN-Y-PK | EKKNGLFGNIIALALGLTPNFKSNF-KLSED-A---KLQ--FSKDTYDDLLDE | 278 |
| WP_003043819 | 212 | LSAR-LSKSKRLEKLIAV-F-PN | EKKNGLFGNIIALALSLDLHPNFKTNF-DLTED-A---KLQ--LSKDTYDDLLDE | 277 |
| WP_062269658 | 212 | LTEK-VSKSSRLENLIAH-Y-PT | EKKNTLFGNLIALSLGLQPNFKTNF-QLSED-A---KLQ--FSKDTYEEDLEG | 277 |
| WP_048800889 | 212 | LTEK-VSKSRRLENLVKC-Y-PT | EKKNTLFGNLIALSLGLQPNFKTNF-QLSED-A---KLQ--FSKDTYEEDLEE | 277 |

```
WP_012767106  212  LSAR-LSKSRRLENLIAQ-L-PG  EKRNGLFGNLIALSLGLTPNFKSNF-DLAED-A---KLQ--LSKDTYDDDLDN  277
WP_014612333  212  LSAR-LSKSRRLENLIAQ-L-PG  EKRNGLFGNLIALSLGLTPNFKSNF-DLAED-A---KLQ--LSKDTYDDDLDN  277
WP_015017095  212  LSAR-LSKSRRLENLIAQ-L-PG  EKRNGLFGNLIALSLGLTPNFKSNF-DLAED-A---KLQ--LSKDTYDDDLDN  277
WP_015057649  212  LSAR-LSKSRRLENLIAQ-L-PG  EKRNGLFGNLIALSLGLTPNFKSNF-DLAED-A---KLQ--LSKDTYDDDLDN  277
WP_048327215  212  LSAR-LSKSRRLENLIAQ-L-PG  EKRNGLFGNLIALSLGLTPNFKSNF-DLAED-A---KLQ--LSKDTYDDDLDN  277
WP_049519324  212  LSAR-LSKSRRLENLIAQ-L-PG  EKRNGLFGNLIALSLGLTPNFKSNF-DLAED-A---KLQ--LSKDTYDDDLDN  277
WP_012515931  212  LSAA-LSKSKRLENLISI-I-PG  QKKTGIFGNIIALSLGLTPNFKANF-DLAED-A---KLQ--LAKDTYADDLDS  277
WP_021320964  212  LSAA-LSKSKRLENLISI-I-PG  QKKTGIFGNIIALSLGLTPNFKANF-GLSKD-V---KLQ--LAKDTYADDLDS  277
WP_037581760  212  LSAA-LSKSKRLENLISL-I-PG  QKKTGIFGNIIALSLGLTPNFKANF-GLSKD-V---KLQ--LAKDTYADDLDS  277
WP_004232481  212  LTEK-ISKSRRLENLIKQ-Y-PT  EKKNTLFGNLVALALGLQPNFKTNF-KLSED-A---KLQ--FSKDTYEEDLEE  277
WP_009854540  213  LTEK-ISKSRRLENLIKY-Y-PT  EKKNTLFGNLIALALGLQPNFKMNF-KLSED-A---KLQ--FSKDTYEEDLEE  278
WP_012962174  213  LTEK-FSKSRRLENLIKH-Y-PT  EKKNTLFGNLVALALGLQPNFKTSF-KLSED-A---KLQ--FSKDTYEEDLEE  278
WP_039695303  213  LTEK-ISKSRRLENLIKY-Y-PT  EKKNTLFGNLIALALGLQPNFKTNF-KLSED-A---KLQ--FSKDTYEEDLEE  278
WP_014334983  212  LTEK-VSKSRRLENLIKQ-Y-PT  EKKNTLFGNLIALALGLQPNFKTNF-ELLED-A---KLQ--FSKDTYEEDLEE  277
WP_003099269  212  LTSK-TSKSRRLENLIAE-I-PN  QKRNMLFGNLVSLALGLTPNFKTNF-ELLED-A---KLQ--ISKDSYEEDLDN  277
AHY15608      212  LTSK-TSKSRRLENLIAE-I-PN  QKRNMLFGNLVSLALGLTPNFKTNF-ELLED-A---KLQ--ISKDSYEEDLDN  277
AHY17476      212  LTSK-TSKSRRLENLIAE-I-PN  QKRNMLFGNLVSLALGLTPNFKTNF-ELLED-A---KLQ--ISKDSYEEDLDN  277
ESR09100                                                                                     
AGM98575      212  LTSK-TSKSRRLENLIAE-I-PN  QKRNMLFGNLVSLALGLTPNFKTNF-ELLED-A---KLQ--ISKDSYEEDLDN  277
ALF27331      212  LTDK-ISKSAKKDRVLKL-F-PD  EKSNGRFAEFLKLIVGNQADFKKHF-ELEEK-A---PLQ--FSKDTYEEELEV  277
WP_018372492  210  FTEN-SSKAKRVETILGL-F-PD  ETAAGNLDKFLKLKLMLGNGNQADFKKVF-DLEEK---iTLQ--FSKDSYEEDLEL  275
WP_045618028  213  FTDK-ISKSAKRERVLKL-F-PD  EKSTGLFSEFLKLIVGNQADFKKHF-DLEDK-A---PLQ--FSKDTYDEDLEN  278
WP_045635197  213  FTDK-ISKSAKRERVLKL-F-PD  EKSTGLFSEFLKLIVGNQADFKKHF-DLEEK-A---PLQ--FSKDTYDEDLEN  278
WP_002263549  212  LTDK-ISKSAKKDRVLKL-F-PN  EKSNGRFAEFLKLIVGNQADFKKHF-ELEEK-A---PLQ--FSKDTYEEELEV  277
WP_002263887  212  LTDK-ISKSAKKDRVLKL-F-PN  EKSNGRFAEFLKLIVGNQADFKKHF-ELEEK-A---PLQ--FSKDTYEEDLEE  277
WP_002264920  212  LTEK-ISKSRRLEKLINN-Y-PK  EKSNGRFAEFLKLIVGNQADFKKHF-KLSED-A---KLQ--FSKDTYEEDLEE  277
WP_002269043  212  LTDK-ISKSAKKDRVLKL-F-PN  EKSNGRFAEFLKLIVGNQADFKKHF-ELEEK-A---PLQ--FSKDTYEEELEV  277
WP_002269448  212  LTDK-ISKSAKKDRVLKL-F-PN  EKSNGRFAEFLKLIVGNQADFKKHF-ELEEK-A---PLQ--FSKDTYEEELEV  277
WP_002271977  212  LTDK-ISKSAKKDRVLKL-F-PN  EKSNGRFAEFLKLIVGNQADFKKHF-ELEEK-A---PLQ--FSKDTYEEDLEE  277
WP_002272766  212  LTDK-ISKSAKKDRVLKL-F-PN  EKSNGRFAEFLKLIVGNQADFKKHF-ELEEK-A---PLQ--FSKDTYEEELEV  277
WP_002273241  212  LTDK-ISKSAKKDRVLKL-F-PN  EKSNGRFAEFLKLIVGNQADFKKHF-ELEEK-A---PLQ--FSKDTYEEELEV  277
WP_002275430  212  LTDK-ISKSAKKDRVLKL-F-PN  EKSNGRFAEFLKLIVGNQADFKKHF-ELEEK-A---PLQ--FSKDTYEEELEV  277
WP_002276448  212  LTEK-ISKSRRLEKLINN-Y-PK  EKSNGRFAEFLKLIVGNQADFKKHF-ELEEK-A---PLQ--FSKDTYEEELEV  277
WP_002277050  212  LTEK-ISKSRRLEKLINN-Y-PK  EKKNTLFGNLIALSLGLQPNFKTNF-ELEEK-A---PLQ--FSKDTYEEDLEE  277
WP_002277364  212  LTDK-ISKSAKKDRVLKL-F-PN  EKSNGRFAEFLKLIVGNQADFKKHF-ELEEK-A---PLQ--FSKDTYEEELEV  277
WP_002279025  212  LTDK-ISKSAKKDRVLKL-F-PN  EKSNGRFAEFLKLIVGNQADFKKHF-ELEEK-A---PLQ--FSKDTYEEELEV  277
WP_002279859  212  LTEK-ISKSRRLEKLINN-Y-PK  EKKNTLFGNLIALSLGLQPNFKTNF-KLSED-A---KLQ--FSKDTYEEELEV  277
WP_002280230  212  LTDK-ISKSAKKDRVLKL-F-PN  EKSNGRFAEFLKLIVGNQADFKKHF-ELEEK-A---PLQ--FSKDTYEEELEV  277
WP_002281696  212  LTDK-ISKSAKKDRVLKL-F-PN  EKSNGRFAEFLKLIVGNQADFKKHF-ELEEK-A---PLQ--FSKDTYEEELEV  277
WP_002282247  212  LTEK-ISKSRRLEKLINN-Y-PK  EKSNGRFAEFLKLIVGNQADFKKHF-KLSED-A---KLQ--FSKDTYEEELEV  277
WP_002282906  212  LTDK-ISKSAKKDRVLKL-F-PN  EKSNGRFAEFLKLIVGNQADFKKHF-ELEEK-A---PLQ--FSKDTYEEELEV  277
WP_002283846  212  LTDK-ISKSAKKDRVLKL-F-PN  EKSNGRFAEFLKLIVGNQADFKKHF-ELEEK-A---PLQ--FSKDTYEEELEV  277
WP_002287255  212  LTDK-ISKSAKKDRVLKL-F-PN  EKSNGRFAEFLKLIVGNQADFKKHF-ELEEK-A---PLQ--FSKDTYEEELEV  277
WP_002288990  212  LTDK-ISKSAKKDRVLKL-F-PN  EKSNGCFAEFLKLIVGNQADFKKHF-ELEEK-A---PLQ--FSKDTYEEELEV  277
WP_002289641  212  LTDK-ISKSAKKDRVLKL-F-PN  EKSNGRFAEFLKLIVGNQADFKKHF-ELEEK-A---PLQ--FSKDTYEEELEV  277
WP_002290427  212  LTDK-ISKSAKKDRVLKL-F-PN  EKSNGRFAEFLKLIVGNQADFKKHF-ELEEK-A---PLQ--FSKDTYEEELEV  277
WP_002295753  212  LTDK-ISKSAKKDRVLKL-F-PN  EKKNTLFGNLIALSLGLQPNFKTNF-ELEEK-A---PLQ--FSKDTYEEELEV  277
WP_002296423  212  LTDK-ISKSAKKDRVLKL-F-PN  EKSNGRFAEFLKLIVGNQADFKKHF-ELEEK-A---PLQ--FSKDTYEEDLEG  277
WP_002304487  212  LTEK-VSKSRRLENLVEC-Y-PT  EKSNGRFAEFLKLIVGNQADFKKHF-QLSED-A---PLQ--FSKDTYEEELEV  277
WP_002305844  212  LTDK-ISKSAKKDRVLKL-F-PN  EKSNGRFAEFLKLIVGNQADFKKHF-ELEEK-A---PLQ--FSKDTYEEELEV  277
WP_002307203  212  LTDK-ISKSAKKDRVLKL-F-PN  EKSNGRFAEFLKLIVGNQADFKKHF-ELEEK-A---PLQ--LSKDTYEEELEV  277
```

-continued

| | | | | |
|---|---|---|---|---|
| WP_002310390 | LTDK-ISKSAKKDRVLKL-F-PN | 212 | EKSNGRFAEFLKLIVGNQADFKKHF-ELEEK-A---PLQ--FSKDIYEEELEV | 277 |
| WP_002352408 | LTDK-ISKSAKKDRVLKL-F-PN | 212 | EKSNGRFAEFLKLIVGNQADFKKHF-ELEEK-A---PLQ--FSKDTYEEELEV | 277 |
| WP_012997688 | LTDK-ISKSAKKDRVLKL-F-PN | 212 | EKSNGRFAEFLKLIVGNQADFKKHF-ELEEK-A---PLQ--FSKDTYEEELEV | 277 |
| WP_014677909 | LTDK-ISKSAKKDRVLKL-F-PN | 212 | EKSNGRFAEFLKLIVGNQADFKKHF-ELEEK-A---PLQ--FSKDIYEEELEV | 277 |
| WP_019312892 | LTDK-ISKSAKKDRVLKL-F-PN | 212 | EKSNGRFAEFLKLIVGNQADFKKHF-ELEEK-A---PLQ--FSKDTYEEELEV | 277 |
| WP_019313659 | LTDK-ISKSAKKDRVLKL-F-PN | 212 | EKSNGRFAEFLKLIIGNQADFKKHF-ELEEK-A---PLQ--FSKDTYEEELEV | 277 |
| WP_019314093 | LTDK-ISKSAKKDRVLKL-F-PN | 212 | EKSNGRFAEFLKLIVGNQADFKKHF-ELEEK-A---PLQ--LSKDTYEEELEV | 277 |
| WP_019315370 | LTDK-ISKSAKKDRVLKL-F-PN | 212 | EKSNGRFAEFLKLIVGNQADFKKHF-ELEEK-A---PLQ--FSKDTYEEELEV | 277 |
| WP_019803776 | LTDK-ISKSAKKDRVLKL-F-PN | 212 | EKSNGRFAEFLKLIVGNQADFKKHF-ELEEK-A---PLQ--FSKDTYEEELEV | 277 |
| WP_019805234 | LTDK-ISKSAKKDRVLKL-F-PN | 212 | EKSNGRFAEFLKLIVGNQADFKKHF-ELEEK-V---PLQ--FSKDTYEEELEV | 277 |
| WP_024783594 | LTDK-ISKSAKKDRVLKL-F-PN | 212 | EKSNGRFAEFLKLIVGNQADFKKHF-ELEEK-A---PLQ--FSKDTYEEELEV | 277 |
| WP_024784288 | LTEK-ISKSRRLEKLINN-Y-PK | 212 | EKNTLFGNLIALSLGLQPNFKTNF-KLSED-A---KLQ--FSKDTYEEDLEE | 277 |
| WP_024784666 | LTDK-ISKSAKKDRVLKL-F-PN | 212 | EKSNGRFAEFLKLIVGNQADFKKHF-ELEEK-A---PLQ--FSKDTYEEELEV | 277 |
| WP_024784894 | LTEK-ISKSAKKDRVLKL-F-PN | 212 | EKKNTLFGNLIALSLGLQPNFKTNF-KLSED-A---KLQ--FSKDTYEEDLEE | 277 |
| WP_024786433 | LTEK-ISKSRRLEKLINN-Y-PK | 212 | EKKNTLFGNLIALSLGLQPNFKTNF-ELEEK-A---PLQ--FSKDTYEEDLEE | 277 |
| WP_049473442 | LTDK-ISKSAKKDRVLKL-F-PN | 212 | EKSNGRFAEFLKLIVGNQADFKKHF-ELEEK-A---PLQ--FSKDTYEEELEV | 277 |
| WP_049474547 | LTDK-ISKSAKKDRVLKL-F-PN | 212 | EKSNGRFAEFLKLIVGNQADFKKHF-ELEEK-A---PLQ--FSKDTYEEELEV | 277 |
| EMC03581 | LTDK-ISKSAKKDRVLKL-F-PN | 205 | EKSTGLFSEFLKLIVGNQADFKKHF-ELEEK-A---PLQ--FSKDTYEEELEV | 270 |
| WP_000428612 | FTDK-ISKSAKRERVLKL-F-PD | 213 | EKSTGLFSEFLKLIVGNQADFKKHF-DLEEK-A---PLQ--FSRDTYDEDLEN | 278 |
| WP_000428613 | FTDK-ISKSAKRERVLKL-F-PD | 213 | EKSTGLFSEFLKLIVGNQADFKKHF-DLGEK-A---PLQ--FSKDTYDEDLEN | 278 |
| WP_049523028 | FTDK-ISKSAKRDRVLKL-F-PD | 212 | EKSTGLFSEFLKLIVGNQADFKKHF-DLEEK-A---PLQ--FSKDTYEEDLES | 277 |
| WP_003107102 | LTEK-MSKSRRLENLIAK-I-PN | 181 | QKKNTLFGNLISLSLGLTPNFKANF-ELSED-A---KLQ--ISKESFEEDLDN | 246 |
| WP_054279288 | LTEK-ISKTRRLENLISN-I-PG | 214 | QKKNGLFGNLIALSLGLTPNFKSHF-NLPED-A---KLQ--LAKDTYDEELNN | 279 |
| WP_049531101 | FTDK-ISKSTKRERVLKL-F-PD | 213 | QKSTGLFSEFLKLIVGNQADFKKHF-DLEEK-A---PLQ--FSKDTYDEDLEN | 278 |
| WP_049538452 | FSDK-ISKSAKRERVLKL-F-PD | 213 | EKSTGLFSEFLKLIVGNQADFKKHF-DLGEK-A---PLQ--FSKDTYDEDLEN | 278 |
| WP_049549711 | FTDK-ISKSAKRERVLKL-F-PD | 214 | EKSTGLFSEFLKLIVGNQADFKKHF-DLGEK-A---PLQ--FSKDTYDEDLEN | 279 |
| WP_007896501 | LTAK-TSKSKRLESLISE-F-PG | 166 | QKKNGLFGNLLALALGLRPNEKSNF-GLSED-A---KLQ--ITKDTYEEELDN | 231 |
| EFR44625 | LTAK-TSKSKRLESLISE-F-PG | 212 | QKKNGLFGNLLALALGLRPNEKSNF-GLSED-A---KLQ--ITKDTYEEELDN | 277 |
| WP_002897477 | FTDK-ISKSAKRERVLKL-F-PD | 212 | EKSTGLFSEFLKLIVGNQADFKKHF-DLEEK-A---PLQ--FSKDTYDEDLEN | 277 |
| WP_002906454 | FTDK-ISKSTKRERVLKL-F-SD | 212 | EKSTGLFSEFLKLIVGNQADFKKHF-DLEEK-A---PLQ--FSKDTYDEDLEN | 277 |
| WP_009729476 | FTDK-ISKSAKRERVLKL-F-PD | 213 | EKSTGLFSEFLKLIVGNQADFKKHF-DLEEK-A---KLQ--FSRDSYDEDLEN | 278 |
| CQR24647 | ITAK-ISKSRKVEAVLEQ-F-PD | 212 | QKKNSFGNMVSLVFGLMPNEKSNF-ELDED-A---KLQ--FSRDSYDEDLEN | 277 |
| WP_000066813 | FTDK-ISKSTKRERVLKL-F-PD | 213 | EKSTGLFSEFLKLIVGNQADFKKHF-DLEEK-A---PLQ--FSKDTYDEDLEN | 278 |
| WP_009754323 | FTGK-ISKSVKREHVLKL-F-PD | 213 | EKKNGLFGNFLALGLGLQPNEKTNF-ELAED-A---SLQ--KIQ--FSKETYEEDLEE | 278 |
| WP_044674937 | LVEK-VSKSRRLENILHY-F-PN | 212 | EKKNGLFGNFLTLALGLQPNEKTNF-ELAED-A---KIQ--FSKETYEEDLEE | 277 |
| WP_044676715 | LVEK-VSKSRRLENILHY-F-PN | 212 | EKKNGLFGNFLALALGLQPNEKTNF-ELAED-A---KIQ--FSKETYEEDLEE | 277 |
| WP_044680361 | LVEK-VSKSRRLENILHY-F-PN | 212 | EKKNGLFGNFLALALGLQPNEKTNF-ELAED-A---KIQ--FSKETYEEDLEE | 277 |
| WP_044681799 | LVEK-VSKSRRLENILHY-F-PN | 212 | EKKNGLFGNFLALALGLQPNEKTNF-ELAED-A---KIQ--FSKETYEEDLEE | 277 |
| WP_049533112 | LVEK-VSKSRRLENILIAH-Y-PA | 212 | EKKNTLFGNLISLGLGLQPNEKTNF-QLSED-A---KLQ--FSKDTYEEDLEG | 277 |
| WP_029090905 | LLDRmMNRSSKVKPLIEL---TG | 172 | KQDKPLLKELFNLIVGLKAKPASIFe---QENlAtivETM-nMSTEQVQLDLLT | 243 |
| WP_060506696 | LKKP-LSKSKVKDEVMTL-IaPE | 211 | KDYKSAFKELVTGIAGNKMNVTKMIlcePIKQ-Gds-EIKlkFSDSNYDDQFSE | 283 |
| AIT42264 | LSAR-LSKSRRLENLIAQ-L-PG | 212 | EKKNGLFGNLIALSLGLTPNEKSNF-DLAED-A---KLQ--LSKDTYDDDLDN | 277 |
| WP_034440723 | FKQD-ISRSKKLDQAIAL-F-QG | 218 | -KRQSLFGIFLFLTLIVGNKANFQKIF-NLEDD----iKLD--LKEEDYDENLEE | 283 |
| AKQ21048 | LSAR-LSKSRRLENLIAQ-L-PG | 212 | EKKNGLFGNLIALSLGLTPNEKSNF-DLAED-A---KLQ--LSKDTYDDDLDN | 277 |
| WP_044636532 | LSSK-QSRSRKHBQIMAL-F-PN | 211 | ENKLGNFGRFMMLIVGNTSNFKPVF-DLDDE-Y---KLK--LSDETYEEDLDT | 276 |
| WP_002364836 | LTEK-ASRTKKSEKVLQQ-F-PQ | 218 | EKANGLFGQFLKLMVGNKADFKKVF--GLEEE-A---KI---tYASESYEEDLEG | 283 |
| WP_016631044 | LTEK-ASRTKKSEKVLQQ-F-PQ | 169 | EKANGLFGQFLKLMVGNKADFKKVF--GLEEE-A---KI---tYASESYEEDLEG | 234 |
| EM575795 | ------------------------- | 1 | ---------MDEE-A---KIQ--LSKESYEEELES | 20 |
| WP_002373311 | LTEK-ASRTKKSEKVLQQ-F-PQ | 218 | EKANGLFGQFLKLMVGNKADFKKVF--GLEEE-A---KI---tYASESYEEDLEG | 283 |
| WP_002378009 | LTEK-ASRTKKSEKVLQQ-F-PQ | 218 | EKANGLFGQFLKLMVGNKADFKKVF--GLEEE-A---KI---tYASESYEEDLEG | 283 |
| WP_002407324 | LTEK-ASRTKKSEKVLQQ-F-PQ | 218 | EKANGLFGQFLKLMVGNKADFKKVF--GLEEE-A---KI---tYASESYEEDLEG | 283 |
| WP_002413717 | LTEK-ASRTKKSEKVLQQ-F-PQ | 218 | EKANGLFGQFLKLMVGNKADFKKVF--GLEEE-A---KI---tYASESYEEDLEG | 283 |
| WP_010775580 | LTEK-ASRTKKSEKVLQQ-F-PQ | 218 | EKANGLFGQFLKLMVGNKADFKKVF--GLEEE-A---KIKitYASESYEEDLEG | 285 |

-continued

| ID | | | | |
|---|---|---|---|---|
| WP_010818269 | 218 | LTEK-ASRTKKSEKVLQQ-F-PQ | EKANGLFGQFLKLMVGNKADFKKVF--GLEEE-A---KI--tYASESYEEDLEG | 283 |
| WP_010824395 | 218 | LTEK-ASRTKKSEKVLQQ-F-PQ | EKANGLFGQFLKLMVGNKADFKKVF--GLEEE-A---KI--tYASESYEEDLEG | 283 |
| WP_016622645 | 218 | LTEK-ASRTKKSEKVLQQ-F-PQ | EKANGLFGQFLKLMVGNKADFKKVF--GLEEE-A---KI--tYASESYEEDLEG | 283 |
| WP_033624816 | 218 | LTEK-ASRTKKSEKVLQQ-F-PQ | EKANGLFGQFLKLMVGNKADFKKVF--GLEEE-A---KI--tYASESYEEDLEG | 283 |
| WP_033625576 | 218 | LTEK-ASRTKKSEKVLQQ-F-PQ | EKANGLFGQFLKLMVGNKADFKKVF--GLEEE-A---KI--tYASESYEEDLEG | 283 |
| WP_033789179 | 217 | FTEK-MSKTKKAETLLKY-F-PH | EKSNGYLSQFIKLMVGNQGNFKNVF--GL-EE-A---KLQ--FSKETYEEDLEE | 281 |
| WP_002310644 | 217 | FTEK-MSKTKKAETLLKY-F-PH | EKSNGYLSQFIKLMVGNQGNFKNVF--GL-EE-A---KLQ--FSKETYEEDLEE | 281 |
| WP_002312694 | 217 | FTEK-MSKTKKAETLLKY-F-PH | EKSNGYLSQFIKLMVGNQGNFKNVF--GL-EEeA---KLQ--FSKETYEEDLEE | 282 |
| WP_002314015 | 217 | FTEK-MSKTKKAETLLKY-F-PH | EKSNGYLSQFIKLMVGNQGNFKNVF--GL-EEeA---KLQ--FSKETYEEDLEE | 282 |
| WP_002320716 | 217 | FTEK-MSKTKKAETLLKY-F-PH | EKSNGYLSQFIKLMVGNQGNFKNVF--GL-EEeA---KLQ--FSKETYEEDLEE | 282 |
| WP_002230729 | 217 | FTEK-MSKTKKAETLLKY-F-PH | EKSNGYLSQFIKLMVGNQGNFKNVF--GL-EE-A---KLQ--FSKETYEEDLEE | 281 |
| WP_002335161 | 217 | FTEK-MSKTKKAETLLKY-F-PH | EKSNGYLSQFIKLMVGNQGNFKNVF--GL-EEeA---KLQ--FSKETYEEDLEE | 282 |
| WP_002345439 | 217 | FTEK-MSKTKKAETLLKY-F-PH | EKSNGYLSQFIKLMVGNQGNFKNVF--GL-EEeA---KLQ--FSKETYEEDLEE | 282 |
| WP_038467970 | 210 | LTDK-LSKTKKVEEILKY-Y-PT | EKINSFFAQCLKLIVGNQANFKRIF--DLEAE-V---KLQ--FSKETYEEDLES | 275 |
| WP_047937432 | 217 | FTEK-MSKTKKAETLLKY-F-PH | EKSNGYLSQFIKLMVGNQGNFKNVF--GL-EEeA---KLQ--FSKETYEEDLEE | 282 |
| WP_010720994 | 210 | LTDK-LSKTKKVEEILKY-Y-PT | EKINSFFAQCLKLIVGNQANFKRIF--DLEAE-V---KLQ--FSKETYEEDLES | 275 |
| WP_010737004 | 210 | LTDK-LSKTKKVEEILKY-Y-PT | EKINSFFAQCLKLIVGNQANFKRIF--DLEAE-V---KLQ--FSKETYEEDLES | 275 |
| WP_034700478 | 210 | LTDK-LSKTKKVEEILKY-Y-PT | EKINSFFAQCLKLIVGNQANFKRIF--DLEAE-V---KLQ--FSKETYEEDLES | 275 |
| WP_007209003 | 215 | LTQQ-LSKSERADNVLKL-F-PD | EKGTGIFAQFIKLIVGNQGNFKKVF--QLEED----qKLQ--LSTDDYEENIEN | 280 |
| WP_023519017 | 210 | LTER-LSKAKRVEKVLAY-Y-PS | EKSTGNFAQFLKLMVGNQANFKKTF--DLEEE-M---KLN--FTRDCYEEDLNE | 275 |
| WP_010770040 | 213 | FSEK-VSRARKVEAILSV-Y-SE | EKSTGTLAQFLKLMVGNQGRFKKTF--DLEED-G---IIQ--IPKEEVEEELET | 278 |
| WP_048604708 | 209 | FADK-VSRAKKAEGVLAL-F-PD | EKRNGTFDQFLKMIVGNQGNFKKTF--ELEED-A---KLQ--FSKEEYDESLEA | 274 |
| WP_010750235 | 210 | LTDK-LSKSKKVEKILQY-Y-PK | EKTTGCLAQFLKLIVGNQGNFKQAF--HLDEE-V---KIQ--ISKEYEEDLEK | 275 |
| AII16583 | 251 | LSAR-LSKSRRLENLIAQ-L-PG | EKKNGLFGNLIALSLGLTPNEKSNF--DLAED-A---KLQ--LSKDTYDDDLDN | 316 |
| WP_029073316 | 216 | LKEP-LSKKHKADKAFAL-FdTT | KDNKAAYKELCAALAGNKFNVTKMLkeAELHD-EdekDIsfkFSDATFDDAFVE | 289 |
| WP_031589969 | 216 | LKEP-LSKKHKAEKAFAL-FdTT | KDNKAAYKELCAALAGNKFNVTKMLkeAELHD-EdekDIsfkFSDATFDDAFVE | 289 |
| KDA45870 | 210 | FKDNtFSKTKKSEELLKL---SG | -KKNQLAHQLFKMMVGNMGSFKKVL--GTDEE---hKLs--FGKDTYEDDLND | 275 |
| WP_039099354 | 207 | LLDNhQSASNRQRQALLLiYtPS | KQNKAIATELLKAILGLKAKFNVLT--GIEARdVkttwTLT--FNAENPDEEMVK | 285 |
| AKP02966 | 209 | LIGR-GNATQKSSNILNN-F--T | KETYKKLLKEVINLILGNVAHLNTIFktsLTKDeE--DIE-S--FSGKDIESKLDD | 278 |
| WP_010991369 | 218 | LVEK-VTRKEKLERILKL-Y-PG | EKSAGMFAQFISLIVGSKGNFQKPF--DLIEK-S---DIE--CAKDSYEEDLES | 283 |
| WP_033838504 | 218 | LVEK-VTRKEKLERILKL-Y-PG | EKSAGMFAQFISLIVGSKGNFQKPF--DLIEK-s---DIE--CAKDSYEEDLES | 283 |
| EHN60060 | 221 | LVEK-VTRKEKLERILKL-Y-PG | EKSAGMFAQFISLIVGSKGNFQKPF--DLIEK-S---DIE--CAKDSYEEDLES | 286 |
| EFR89594 | 1 | ----------------------- | ------------------------------------------------------ | 52 |
| WP_038409211 | 218 | LSEK-LTRREKLDKILKL-Y-TG | EKSTGMFARFINLIIGSKGDFKKVF--DLDEK-A---EIE--CAKDTYEEDLEA | 283 |
| EFR95520 | | | | |
| WP_003723650 | 218 | LAGK-FTRREKFERILQL-Y-PG | EKSTDLFAQFISLIIGSKGNFKKFF--DLIEK-T---DIE--CAKDSYEEDLET | 283 |
| WP_003727705 | 218 | LAGK-FTRREKFPERILRL-Y-PG | EKSTGMFAQFISLIVGNKGNFQKVF--DLIEK-T---DIE--CAKDSYEEDLEA | 283 |
| WP_003730785 | 218 | LAGK-FTRREKFERILRL-Y-PG | EKSTGMFAQFISLIVGNKGNFQKVF--NLIVEK-T---DIE--CAKDSYEEDLEA | 283 |
| WP_003733029 | 218 | LAEK-FTRKDKLDKILSL-Y-PG | EKTTGVFAQFVNIIVGSTGKEKKHF--NLHEK-K---DIN--CAEDYDTDLES | 283 |
| WP_003739838 | 218 | LAGK-FTRKEKLERILQL-Y-PG | EKSAGMFAQFISLIVGSKGNFQKVF--DLIVEK-T---DIE--CAKDSYEEDLEA | 283 |
| WP_014601172 | 218 | LAGK-FTRREKFERILQL-Y-PG | EKSTGMFAQFISLIVGSKGNFQKVF--DLIEK-T---DIE--CAKDSYEEDLEA | 283 |
| WP_023548323 | 218 | LAGK-FTRREKFERILQL-Y-PG | EKSTGMFAQFISLIVGSKGNFQKVF--DLIEK-T---DIE--CAKDSYEEDLEA | 283 |
| WP_031665337 | 218 | LAGK-FTRKDKLDKILSL-Y-PG | EKTTGVFAQFVNIIVGSTGKEKKHF--NLHEK-K---DIN--CAEDYDTDLES | 283 |
| WP_031669209 | 218 | LAEK-FTRKDKLDKILSL-Y-PG | EKTTGVFAQFVNIIVGSTGKEKKHF--NLHEK-K---DIN--CAEDYDTDLES | 283 |
| WP_033920898 | 218 | LARK-FTRREKFERILQL-Y-PG | EKSTGMFAQFISLIVGSKGNFQKVF--DLIEK-T---DIE--CAKDSYEEDLET | 283 |
| AKI42028 | 221 | LAGK-FTRREKFERILQL-Y-PG | EKSTGMFAQFISLIVGSKGNFQKVF--DLIEK-T---DIE--CAKDSYEEDLEA | 286 |
| AKI50529 | 221 | LARK-FTRREKFERILQL-Y-PG | EKSTGMFAQFISLIVGSKGNFQKVF--DLIEK-T---DIE--CAKDSYEEDLET | 286 |
| EFR83390 | | | | |
| WP_046323366 | 218 | FSEK-LTKREKLDKILNL-Y-PN | EKSTDLFAQFISLIIGSKGNFKKFF--NLTEK-T---DIE--CAKDSYEEDLEV | 283 |
| AKE81011 | 228 | LSAR-LSKSRRLENLIAQ-L-PG | EKKNGLFGNLIALSLGLTPNEKSNF--DLAED-A---KLQ--LSKDTYDDDLDN | 293 |
| CU082355 | 215 | LKKP-LSKKAKVDEVMAL-IsPE | KEEKSAYKELVTGIAGNKMNVTKMIlcESIKQ-Gds-EIKlkFSDSNYDDQFSE | 287 |
| WP_033162887 | 216 | LSKI-YQRSKKADDLLKI-MnPT | KEEKAAYKEFTKALVGLKENISKMIlaQEVKK-Gdt-DIVleFSNANYDSTIDE | 288 |
| AGZ01981 | 245 | LSAR-LSKSRRLENLIAQ-L-PG | EKKNGLFGNLIALSLGLTPLIFKSNF-DLAED-A---KLQ--LSKDTYDDDLDN | 310 |

| | | | |
|---|---|---|---|
| AKA60242 | 212 | LSAR-LSKSRRLENLIAQ-L-PG | EKKNGLFGNLIALSLGLTPLIFKSNF-DLAED-A---KLQ-LSKDTYDDDLDN | 277 |
| AKS40380 | 212 | LSAR-LSKSRRLENLIAQ-L-PG | EKKNGLFGNLIALSLGLTPLIFKSNF-DLAED-A---KLQ-LSKDTYDDDLDN | 277 |
| 4UN5_B | 216 | LSAR-LSKSRRLENLIAQ-L-PG | EKKNGLFGNLIALSLGLTPLIFKSNF-DLAED-A---KLQ-LSKDTYDDDLDN | 281 |
| 5AXW_A | 158 | | | |
| WP_010922251 | 278 | LLAQIGDQYADLFLAAKNLSDAILLSDIILRVNTEIITKAPLSASMIKRYDEHHQDLTLLKALVRQQ-LPEKYKEIFFDQSK | 356 |
| WP_009880683 | 1 | | LSASMIKRYDEHHQDLTLLKALVRQQ-LPEKYKEIFFDQSK | 40 |
| WP_010922251 | 278 | LLAQIGDQYADLFLAAKNLSDAILLSDIILRVNTEITKAPLSASMIKRYDEHHQDLTLLKALVRQQ-LPEKYKEIFFDQSK | 356 |
| WP_011054416 | 278 | LLAQIGDQYADLFLAAKNLSDATLLSDIILRVNSEITKAPLSASMIKRYDEHHQDLTLLKALVRQQ-LPEKYKEIFFDQSK | 356 |
| WP_011284745 | 278 | LLAQIGDQYADLFLAAKNLSDAILLSDIILRLNSEITKAPLSASMIKRYDEHHQDLTLLKALVRQQ-LPEKYKEIFFDQSK | 356 |
| WP_011285506 | 278 | LLAQIGDQYADLFLAAKNLSDAILLSDIILRLNSEITKAPLSASMIKRYDEHHQDLTLLKALVRQQ-LPEKYKEIFFDQSK | 356 |
| WP_011527619 | 278 | LLAQIGDQYADLFLAAKNLSDAILLSDIILRVNTEITKAPLSASMIKRYDEHHQDLTLLKALVRQQ-LPEKYKEIFFDQSK | 356 |
| WP_012560673 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_014407541 | 278 | LLAQIGDQYADLFLAAKNLSDAILLSDIILRLNSEITKAPLSASMIERYENHQNDLAALKQFIKNN-LPEKYDEVFSDQSK | 356 |
| WP_020905136 | 278 | LLAQIGDQYADLFLAAKNLSDAILLSDIILRLNSEITKAPLSASMIKRYDEHHQDLTLLKALVRQQ-LPEKYKEIFFDQSK | 356 |
| WP_023080005 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_023610282 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_030125963 | 278 | LLAQIGDQYADLFLAAKNLSDAILLSDIILRVNTEITKASLSASMIKRYDEHHQDLTLLKALVRQQ-LPEKYKEIFFDQSK | 356 |
| WP_030126706 | 278 | LLAQIGDQYADLFLAAKNLSDATLLSDIILRVNSEITKAPLSASMIKRYDEHHQDLTLLKALVRQQ-LPEKYKEIFFDQSK | 356 |
| WP_031488318 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_032460140 | 278 | LLAQIGDQYADLFLAAKNLSDAILLSDIILRVNTEITKAPLSASMIKRYDEHHQDLTLLKALVRQQ-LPEKYKEIFFDQSK | 356 |
| WP_032461047 | 278 | LLAQIGDQYADLFLAAKNLSDAILLSDIILRLNSEITKAPLSASMIKRYDEHHQDLTLLKALVRQQ-LPEKYKEIFFDQSK | 356 |
| WP_032462016 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_032462936 | 278 | LLAQIGDQYADLFLAAKNLSDAILLSDIILRVNTEITKAPLSASMIKRYDEHHQDLTLLKALVRQQ-LPEKYKEIFFDQSK | 356 |
| WP_032464890 | 278 | LLAQIGDQYADLFLAAKNLSDAILLSDIILRLNSEITKAPLSASMIKRYDEHHQDLTLLKALVRQQ-LPEKYKEIFFDQSK | 356 |
| WP_033888930 | 103 | LLAQIGDQYADLFLAAKNLSDAILLSDIILRVNSEITKAPLSASMIKRYDEHHQDLTLLKALVRQQ-LPEKYKEIFFDQSK | 181 |
| WP_038431314 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_038432938 | 278 | LLAQIGDQYADLFLAAKNLSDAILLSDIILRVNSEITKAPLSASMIKRYDEHHQDLTLLKALVRQQ-LPEKYKEIFFDQSK | 356 |
| WP_038434062 | 189 | LLAQIGDQYADLFLAAKNLSDAILLSDIILRVNTEITKAPLSASMIKRYDEHHQDLTLLKALVRQQ-LPEKYKEIFFDQSK | 267 |
| BAQ51233 | | | | |
| KGE60162 | | | | |
| KGE60856 | | | | |
| WP_002989955 | 278 | LLAQIGDQYADLFLAAKNLSDAILLSDIILRVNTEITKAPLSASMIKRYDEHHQDLTLLKALVRQQ-LPEKYKEIFFDQSK | 356 |
| WP_003030002 | 278 | LLGEIGDEYADLFASAKNLYDAILLSGILTVDDNSTKAPLSASMVKKYEEHQKDLKKLKDFIKVN-APDQYNAIFKDKNK | 356 |
| WP_003065552 | 281 | LLGKIGDDYADLFTSAKNLYDAILLSGILTVTDPSTKAPLSASMIERYVEHQRDLEKLKEFIKAN-KSELYHDIFKDKNK | 359 |
| WP_001040076 | 279 | LLGQIGDEFADLFSAAKKLYDSVLLSGILTVTDLSTKAPLSASMIQRYDEHREDLKQLKQFVKAS-LPEKYDEIVADSSK | 357 |
| WP_001040078 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040080 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040081 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040083 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040085 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040087 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040088 | 279 | LLGQIGDEFADLFSAAKKLYDSVLLSGILTVTDLSTKAPLSASMIQRYDEHREDLKQLKQFVKAS-LPEKYQEIFADSSK | 357 |
| WP_001040089 | 279 | LLGQIGDEFADLFSAAKKLYDSVLLSGILTVIDLSTKAPLSASMIQRYDEHREDLKQLKQFVKAS-LPEKYQEIFADSSK | 357 |
| WP_001040090 | 279 | LLGQIGDEFADLFSAAKKLYDSVLLSGILTVTDLSTKAPLSAYMIQRYDEHREDLKQLKQFVKAS-LPEKYQEIFADSSK | 357 |
| WP_001040091 | 279 | LLRQIGDEFADLFSAAKKLYDSVLLSGILTVIDLSTKAPLSASMIQHYDEHREDLKQLKQFVKAS-LPEKYQEIFADSSK | 357 |
| WP_001040092 | 279 | LLGQIGDEFADLFSAAKKLYDSVLLSGILTVTDLSTKAPLSASMIQRYDEHREDLKQLKQFVKAS-LPEKYQEIFADSSK | 357 |
| WP_001040094 | 279 | LLGQIGDEFADLFSAAKKLYDSVLLSGILTVTDLSTKAPLSASMIQRYDEHREDLKQLKQFVKAS-LPEKYQEIFADSSK | 357 |
| WP_001040095 | 279 | LLGQIGDEFADLFSAAKKLYDSVLLSGILTVTDLSTKAPLSASMIQRYDEHREDLKQLKQFVKAS-LPEKYQEIFADSSK | 357 |

```
WP_001040096  279  LLGQIGDEFADLFSAAKKLYDSVLLSGILTVTDLSTKAPLSASMIQRYDEHREDLKQLKQFVKAS-LPEKYQEIFADSSK  357
WP_001040097  279  LLGQIGDEFADLFSAAKKLYDSVLLSGILTVTDLSTKAPLSASMIQRYDEHREDLKQLKQFVKAS-LPEKYQEIFADSSK  357
WP_001040098  279  LLGQIGDEFADLFSAAKKLYDSVLLSGILTVTDLSTKAPLSASMIQRYDEHREDLKQLKQFVKAS-LPEKYQEIFADSSK  357
WP_001040099  279  LLGQIGDEFADLFSAAKKLYDSVLLSGILTVTDLSTKAPLSASMIQRYDEHREDLKQLKQFVKAS-LPEKYQEIFADSSK  357
WP_001040100  279  LLGQIGDEFADLFSAAKKLYDSVLLSGILTVIDLSTKAPLSASMIQRYDEHREDLKQLKQFVKAS-LPEKYQEIFADSSK  357
WP_001040104  279  LLGQIGDEFADLFSAAKKLYDSVLLSGILTVIDLSTKAPLSASMIQRYDEHREDLKQLKQFVKAS-LPEKYQEIFADSSK  357
WP_001040105  279  LLGQIGDEFADLFSAAKKLYDSVLLSGILTVIDLSTKAPLSASMIQRYDEHREDLKQLKQFVKAS-LPEKYQEIFADSSK  357
WP_001040106  279  LLGQIGDEFADLFSVAKKLYDSVLLSGILTVTDLSTKAPLSASMIQRYDEHREDLKQLKQFVKAS-LPEKYQEIFTDSSK  357
WP_001040107  279  LLGQIGDEFADLFSVAKKLYDSVLLSGILTVTDLSTKAPLSASMIQRYDEHREDLKQLKQFVKAS-LPEKYQEIFTDSSK  357
WP_001040108  279  LLGQIGDEFADLFSAAKKLYDSVLLSGILTVTDLSTKAPLSASMIQRYDEHREDLKQLKQFVKAS-LPEKYQEIFTDSSK  357
WP_001040109  279  LLGQIGDEFADLFSVAKKLYDSVLLSGILTVTDLSTKAPLSASMIQRYDEHREDLKQLKQFVKAS-LPEKYQEIFTDSSK  357
WP_001040110  279  LLGQIGDEFADLFSVAKKLYDSVLLSGILTVTDLSTKAPLSASMIQRYDEHREDLKQLKQFVKAS-LPEKYQEIFTDSSK  357
WP_015058523  279  LLGQIGDEFADLFSAAKKLYDSVLLSGILTVTDLSTKAPLSASMIQRYDEHREDLKQLKQFVKAS-LPEKYQEIFADSSK  357
WP_017643650  279  LLGQIGDEFADLFSAAKKLYDSVLLSGILTVIDLSTKAPLSASMIQRYDEHREDLKQLKQFVKAS-LPEKYQEIFADSSK  357
WP_017647151  279  LLGQIGDEFADLFSAAKKLYDSVLLSGILTVIDLSTKAPLSASMIQRYDEHREDLKQLKQFVKAS-LPEKYQEIFADSSK  357
WP_017648376  279  LLGQIGDEFADLFSVAKKLYDSVLLSGILTVTDLSTKAPLSASMIQRYDEHREDLKQLKQFVKAS-LPEKYQEIFTDSSK  357
WP_017649527  279  LLGQIGDEFADLFSAAKKLYDSVLLSGILTVIDLSTKAPLSASMIQRYDEHREDLKQLKQFVKAS-LPEKYQEIFTDSSK  357
WP_017771611  279  LLGQIGDEFADLFSAAKKLYDSVLLSGILTVTALSTKAPLSASMIQRYDEHREDLKQLKQFVKAS-LPEKYQEIFTDSSK  357
WP_017771984  279  LLGQIGDEFADLFSAAKKLYDSVLLSGILTVIDLSTKAsLSDSMIQRYDEHREDLKQLKQFVKAS-LPEKYQEIFADSSK  357
CFQ25032      279  LLGQIGDEFADLFSAAKKLYDSVLLSGILTVIDLSTKAPLSASMIQRYDEHREDLKQLKQFVKAS-LPEKYQEIFADSSK  357
CFV16040      279  LLGQIGDEFADLFSAAKKLYDSVLLSGILTVIDLSTKAPLSASMIQRYDEHREDLKQLKQFVKAS-LPEKYQEIFADSSK  357
KLJ37842      279  LLGQIGDEFADLFSAAKKLYDSVLLSGILTVIDLSTKAPLSASMIQRYDEHREDLKQLKQFVKAS-LPEKYQEIFADSSK  357
KLJ72361      279  LLGQIGDEFADLFSAAKKLYDSVLLSGILTVIDLSTKAPLSASMIQRYDEHREDLKQLKQFVKAS-LPEKYQEIFADSSK  357
KLL20707      279  LLGQIGDEFADLFSAAKKLYDSVLLSGILTVIDLSTKAPLSASMIQRYDEHREDLKQLKQFVKAS-LPEKYQEIFADSSK  357
KLL42645      279  LLGQIGDEFADLFSAAKKLYDSVLLSGILTVIDLSTKAPLSASMIQRYDEHREDLKQLKQFVKAS-LPEKYQEIFADSSK  357
WP_047207273  279  LLGQIGDEFADLFSAAKKLYDSVLLSGILTVIDLSTKAPLSASMIQRYDEHREDLKQLKQFVKAS-LPEKYQEIFADSSK  357
WP_047209694  279  LLGQIGDEFADLFSAAKKLYDSVLLSGILTVTDLSTKAPLSASMIQRYDEHREDLKQLKQFVKAS-LPEKYQEIFADSSK  357
WP_050198062  279  LLGQIGDEFADLFSAAKKLYDSVLLSGILTVTDLSTKAPLSASMIQRYDEHREDLKQLKQFVKAS-LPEKYQEIFADSSK  357
WP_050201642  279  LLGQIGDEFADLFSAAKKLYDSVLLSGILTVIDLSTKAPLSASMIQRYDEHREDLKQLKQFVKAS-LPEKYQEIFTDSSK  357
WP_050204027  279  LLGQIGDEFADLFSAAKKLYDSVLLSGILTVTDLSTKAPLSASMIQRYDEHREDLKQLKQFVKAS-LPEKYQEIFADSSK  357
WP_050881965  279  LLGQIGDEFADLFSAAKKLYDSVLLSGILTVIDLSTKAPLSASMIQRYDEHREDLKQLKQFVKAS-LPEKYQEIFDDTK  357
WP_050886065  279  LLGQIGDEFADLFSAAKKLYDSVLLSGILTVTDLSTKAPLSASMIQRYDEHREDLKQLKQFVKAS-LPEKYQEIFADSSK  357
AHN30376      279  LLGQIGDEFADLFSAAKKLYDSVLLSGILTVTDLSTKAPLSASMIQRYDEHREDLKQLKQFVKAS-LPEKYQEIFADSSK  357
EA078426      279  LLGQIGDEFADLFSAAKKLYDSVLLSGILTVTDLSTKAPLSASMIQRYDEHREDLKQLKQFVKAS-LPEKYQEIFADSSK  357
CCW42055      279  LLGEVGDEFADLFSAAKNLYDAILLSGILTVDDNSTKAPLSASMVKRYEEHQKDLKKFPEDFIKVN-ALDQYNAIFKDKNK  357
WP_003041502  278  LLGEIGDEYADLFASAKNLYDAILLSGILAVDDNTTKAPLSASMVKRYEEHQKDLKKLKDFIKVN-APDQYNAIFKDKNK  356
WP_037593752  278  LLGEIGDEYADLFASAKNLYDAILLSGILAVDDNTTKAPLSASMVKRYEEHQKDLKKLKDFIKVN-APAQYDDIFKDETK  356
WP_049516684  279  LLGEIGDEYADLFASAKNLYDAILLSGILAVDDNTTKAPLSASMVKRYEEHQKDLKKLKDFIKVN-APDQYNAIFKDKNK  357
GAD46167      278  LLGEIGDEYADLFASAKNLYDAILLSGILAVDDNTTKAPLSASMVKRYEEHQKDLKKLKDFIKAN-KSELYHDIFKDKTQ  356
WP_018363470  278  LLGKIGDEYADLFTSSKNLYDAILLSGILSGILTSGILTSGILSGILTSGIL... [error in alignment]
WP_030043819  278  LLGQIGDQYADLFLAAKNLSDAILLSDILRSNSEVTKAPLSASMVKRYDEHHQDLALLKTLVRQQ-FPEKYAEIFKDDTK  356
WP_006269658  278  FLGEVGDEYADLFASAKNIYDAILLSGILTVDDNSTKAPLSASMIKRYDEHHQDLKKLKDFIKVN-APDQYNAIFKDKNK  356
WP_048800889  278  LLGKIGDDYADLFTSAKNLYDTILLSGILSGILTVDDNSTRALLSASMVKRYEEHHQDLTLLKALVRQQ-LPEKYKEIFDETK  356
WP_012767106  278  LLAQIGNQYADLFLAAKNLSDAILLSDILRVNSEITKAPLSASMIKRYDEHHQDLTLLKALVRQQ-LPEKYKEIFDQSK  356
WP_014612333  278  LLAQIGNQYADLFLAAKNLSDAILLSDILRVNSEITKAPLSASMIKRYDEHHQDLTLLKALVRQQ-LPEKYKEIFDQSK  356
WP_015017095  278  LLAQIGDQYADLFLAAKNLSDAILLSDILRVNSEITKAPLSASMIKRYDEHHQDLTLLKALVRQQ-LPEKYKEIFDQSK  356
WP_015057649  278  LLAQIGDQYADLFLAAKNLSDAILLSDILRVNSEITKAPLSASMIKRYDEHHQDLTLLKALVRQQ-LPEKYKEIFDQSK  356
WP_048327215  278  LLAQIGDQYADLFLAAKNLSDAILLSDILRVNSEITKAPLSASMIKRYDEHHQDLTLLKALVRQQ-LPEKYKEIFDQSK  356
WP_049519324  278  LLAQIGDQYADLFLAAKNLSDAILLSDILRVNSEITKAPLSASMIKRYDEHHQDLTLLKALVRQQ-LPEKYKEIFDQSK  356
WP_012515931  278  LLAQIGDOYADLFLAAKNLSDAILLSDILTESDEITRAPLSASMVKRYREHHKDLVTLKTLIKDQ-LPEKYQEIFLDKTK  356
WP_021320964  278  LLAQIGDOYADLFLAAKNLSDAILLSDILTESDEITRAPLSASMVKRYREHHKDLVTLKTLIKDQ-LPEKYQEIFLDKTK  356
WP_037581760  278  LLAQIGDOYADLFLAAKNLSDAILLSDILTESDEITRAPLSASMVKRYREHHKDLVTLKTLIKDQ-LPEKYQEIFLDKTK  356
WP_004232481  278  LLGKIGDDYADLFTAAKNLYDAILLSGILTVDDNSTKAPLSASMIKRYEEHHEDLEKLKTFIKVN-NFDKYHEIFKDKSK  356
```

| | | | |
|---|---|---|---|
| WP_009854540 | 279 | LLGKIGDDYADLFTSAKNLYDAILLSGILTVDDNSTKAPLSASMIKRYVEHHEDLEKLKEFIKAN-KSELYHDIFKDKNK | 357 |
| WP_012962174 | 279 | LIGKIGDEYADLFTSAKNLYDAILLSGILTVADNTTKAPLSASMIKRYNEHQVDLKKLKEFIKNN-ASDKYDEIFNDKDK | 357 |
| WP_039695303 | 279 | LLGKIGDDYADLFTSAKNLYDAILLSGILTVDDNSTKAPLSASMIKRYVEHHEDLEKLKEFIKAN-KSELYHDIFKDKNK | 357 |
| WP_014334983 | 278 | LLGKVGDDYADLFISAKNLYDAILLSGILTVDDNSTKAPLSASMIKRYVEHHEDLEKLKEFIKIN-KLKLYHDIFKDKTK | 356 |
| WP_003099269 | 278 | LLAQIGDQYADLFIAAKLSDAILLSDIITVKGASTKAPLSASMVQRYEEHQQDLALLKNLVKKQ-IPEKYKEIFDNKEK | 356 |
| AHY15608 | 278 | LLAQIGDQYADLFIAAKLSDAILLSDIITVKGASTKAPLSASMVQRYEEHQQDLALLKNLVKKQ-IPEKYKEIFDNKEK | 356 |
| AHY17476 | 278 | LLAQIGDQYADLFIAAKLSDAILLSDIITVKGASTKAPLSASMVQRYEEHQQDLALLKNLVKKQ-IPEKYKEIFDNKEK | 356 |
| ESR09100 | | ---------------------------------------------------------------- | |
| AGM98575 | 278 | LLAQIGDQYADLFIAAKLSDAILLSDIITVKGASTKAPLSASMVQRYEEHQQDLALLKNLVKKQ-IPEKYKEIFDNKEK | 356 |
| ALF27331 | 278 | LLAQIGDNYAELFLSAKKLYDSILLSGILTVDVSTKAPLSASMIKRYNEHQMDLAQLKQFIRQK-LSDKYNEVFSDVSK | 356 |
| WP_018372492 | 276 | LLSKIDEYAALFDLAKKVYDALLLVDAVLLSNILTVKEKNTKAPLSASMIKRYEEHKDDLKAPKRFPFRER-LPEKYETMFKDLTK | 354 |
| WP_045618028 | 279 | LIVQIGDDFADLFLVAKKLVYDAVLLSNILTVKEKNTKAPLSASMIDRYENHQKDLAALKQFIKTN-LPEKYDEVFSDQSK | 357 |
| WP_045635197 | 278 | LLGQIGDDFDTDLFVSAKKLYDAILLSGILTVDPSTKAPLSASMIERYENHQNDLAALKQFIKNN-LPEKYDEVFSDQSK | 356 |
| WP_002263549 | 278 | LLAQIGDNYAELFLSAKKLYDSILLSGILTVDVGTKAPLSASMIQRYNEHQMDLAQLKQFIRQK-LSDKYNEVFSDVSK | 356 |
| WP_002263887 | 278 | LLAQIGDNYAELFLSAKKLYDSILLSGILTVDVGTKAPLSASMIQRYNEHQMDLAQLKQFIRQK-LSDKYNEVFSDVSK | 356 |
| WP_002264920 | 278 | LLGKIGDDYADLFTLAKNLYDAILLSGILTVDVSTKAPLSASMIKRYAEHHEDLEKLKEFIKAN-KPELYHDIFKDETK | 356 |
| WP_002269043 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002269448 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002271977 | 278 | LLGKIGDYADLFTLAKNLYDAILLSGILTADDSSTKAPLSASMIQRYNEHQMDLAQLKQFIRQK-LSDKYNEVFSDVSK | 356 |
| WP_002272766 | 278 | LLGKIGDDLFTLAKNLYDAILLSGILTADDSSTKAPLSASMIQRYNEHQMDLAQLKQFIRQK-LSDKYNEVFSDVSK | 356 |
| WP_002273241 | 278 | LLTQIGDNYAELFLSAKKLYDSILLSGILTVDVSTKAPLSASMIQRYNEHQMDLAQLKQFIRQK-LSDKYNEVFSDVSK | 356 |
| WP_002275430 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002276448 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002277050 | 278 | LLGKIGDDYADLFTLAKNLYDAILLSGILTVDVSTKAPLSASMIKRYAEHHEDLEKLKEFIKAN-KPELYHDIFKDETK | 356 |
| WP_002277364 | 278 | LLAQIGDNYAELFLSAKKLYDSILLSGILTVDVGTKAPLSASMIQRYNEHQMDLAQLKQFIRQK-LSDKYNEVFSDVSK | 356 |
| WP_002279025 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002279859 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002280230 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002281696 | 278 | LLGKIGDEYADLFTLAKNLYDAILLSGILAVDDNTTKAPLSASMVKRYAEHHEDLEKLKEFIKAN-KPELYHDIFKDETK | 356 |
| WP_002282247 | 278 | LLGKIGDDYADLFTLAKNLYDAILLSGILTVDVSTKAPLSASMIKRYAEHHEDLEKLKEFIKAN-KPELYHDIFKDETK | 356 |
| WP_002282906 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002283846 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002287255 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002289990 | 278 | LLAQIGDNYAELFLSAKKLYDSILLSGILTVDVSTKAPLSASMIQRYNEHQMDLTQLKQFIRQK-LSDKYNEVFSDVSK | 356 |
| WP_002289641 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002290427 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002295753 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002296423 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002304487 | 278 | LIGEIGDEYADLFLASAKNLYDAILLSGILAVDDNTTKAPLSASMVKRYKEHKEELAAPKRFIKEK-LPKKYEIFKDDTK | 356 |
| WP_002305844 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002307203 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002310390 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_002352408 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_012997688 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_014677909 | 278 | LLAQIGDNYAELFLSAKKLYDSILLSGILTVDVSTKAPLSASMIQRYNEHQMDLTQLKQFIRQK-LSDKYNEVFSDVSK | 356 |
| WP_019312892 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_019313659 | 278 | LLAQIGDNYAELFLSAKKLYDSILLSGILTVDVGTQAPLSASMIQRYNEHQMDLAQLKQFIRQK-LPKKYEIFKDDTK | 356 |
| WP_019314093 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_019315370 | 278 | LLAQIGDNYAELFLSAKKLYDSILLSGILTVDVSTKAPLSASMIQRYNEHQMDLTQLKQFIRQK-LSDKYNEVFSDVSK | 356 |
| WP_019803776 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_019805234 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_024783594 | 278 | LLAQIGDNYAELFLSAKKLYDSILLSGILTVDVSTKAPLSASMIQRYNEHQMDLAQLKQFIRQK-LSDKYNEVFSDVSK | 356 |
| WP_024784288 | 278 | LLGKIGDDYADLFTLAKNLYDAILLSGILTADDSSTKAPLSASMIKRYAEHHEDLEKLKEFIKAN-KPELYHDIFKDETK | 356 |

| | | | |
|---|---|---|---|
| WP_024784666 | 278 | LLAQIGDNYAELFLSAKKLYDSILLSGILTVTDVSTKAPLSASMIQRYNEHQMDLVQLKQFIRQK-LSDKYNEVFSDVSK | 356 |
| WP_024788894 | 278 | LLAQIGDNYAELFLSAKKLYDSILLSGILTVTDVSTKAPLSASMIQRYNEHQMDLTQLKQFIRQK-LSDKYNEVFSDVSK | 356 |
| WP_024786433 | 278 | LLGKIGDDYADLFTLAKNLYDAILLSGILTADDSSTKAPLSASMIKRYAEHHEDLEKLKEFIKAN-KPELYHDIFKDETK | 356 |
| WP_049473442 | 278 | LLGKIGDDYADLFTLAKNLYDAILLSGILTVTDVSTKAPLSASMIQRYNEHQMDLAQLKQFIRQK-LSDKYNEVFSDVSK | 356 |
| WP_049474547 | 278 | LLAQIGDNYAELFLSAKKLYDSILLSGILTVTDVSTKAPLSASMIQRYNEHQMDLAQLKQFIRQK-LSDKYNEVFSDVSK | 356 |
| EMC03581 | 271 | LLAQIGDNYAELFLSAKKLYDSILLSGILTVTDVSTKAPLSASMIQRYNEHQMDLTQLKQFIRQK-LSDKYNEVFSDVSK | 349 |
| WP_000428612 | 279 | LLGQIGDDFADLFVAAKLYDAILLSGILTVTDPSTKAPLSASMIERYENHQKDLATLKQFIKTN-LPEKYDEVFSDQSK | 357 |
| WP_000428613 | 279 | LLGQIGDDFADLFLVAAKLYDAILLSGILTVTDPSTKAPLSASMIERYENHQKDLAVLKQFIKNN-LPEKYDEVFSDQSK | 357 |
| WP_049523028 | 278 | LLGQIGDVYADLFVVAKKLYDAILLAGILSVKDPGTKAPLSASMIERYDNHQNDLSALKQFVRRN-LPEKYAEVFSDDSK | 356 |
| WP_003107102 | 247 | LLAQIGDQYADLFIAAKNLSDAILLSDILTVKGVNTKAPLSASMVQRFNEHQDDLKLLKKLVKVQ-LPDLYRDVFTDENK | 325 |
| WP_054279288 | 280 | LLTQIGDDYADLFLSAKNLSDAILLSDILTVNGDGTQAPLSASLIKRYEEHRQDLALLKQMFKEQ-LPDLYRDVFTDENK | 358 |
| WP_049531101 | 279 | LLGQIGDDFADLFLVAKKLYDAILLSGILTVTDPSTKAPLSASMIERYENHQKDLAALKQFIKNN-LPEKYDEVFSDQSK | 357 |
| WP_049538452 | 279 | LLGQIGDGFADLFLVAKKLYDAILLSGILTVTDPSTKAPLSASMIERYQNHQNDLASLKQFIKNN-LPEKYDEVFSDQSK | 357 |
| WP_049549711 | 279 | LLGQIGDDFADLFLVAKKLYDAILLSGILTVTDPSTKAPLSASMIKRYENHQKDLTTLKQFIKNN-LPEKYDEVFSDQSK | 357 |
| WP_007896501 | 280 | LLAEIGDHYADLFLAAKNLSDAILLSDILTLSDENTRAPLSASMIKRYEEHQEDLALLKKLVKEQ-MPEKYWEIFSNAKK | 358 |
| EFR44625 | 232 | LLAEIGDHYADLFLAAKNLSDAILLSDILTLSDENTRAPLSASMIKRYEEHQDLALLKLKLVKEQ-MPEKYWEIFSNAKK | 310 |
| WP_002897477 | 278 | LLGQIGDDFADLFLIAKKLYDAILLSGILTVTDPSTKAPLSASMIERYENHQKDLAALKQFIKNN-LPEKYVEVFSDQSK | 356 |
| WP_002906454 | 278 | LLGQIGDFADLFLVAKKLYDAILLSGILTVTDPSTKAPLSASMIERYENHQKDLAALKQFIKNN-LSEKYAEVFSDQSK | 356 |
| WP_009729476 | 279 | LLGQIGDDFADLFLVAKKLYDAILLSGILTVTNPSTKAPLSASMIERYENHQKDLASLKQFIKNN-LPEKYDEVFSDQSE | 357 |
| CQR24647 | 278 | LLGIIGDDYADVFVAAKKVYDSILLSGILTTNMSVTKAPLSASMIDRYDEHNSDKKLLRDFIRTNiGKEVFKEVFYDTSK | 357 |
| WP_000666813 | 279 | LLGQIGDDFADLFLIAKKLYDAILLSGILTVKDLSTKAPLSASMIERYENHQKDLAALKQFIQNN-LQEKYDEVFSDQSK | 357 |
| WP_009754323 | 279 | LLGQIGDDFADLFLVAKKLYDAILLSGILTVTDPSTKAPLSASMIERYENHQEDLAALKQFIKNN-LPEKYAEVFSDQSK | 357 |
| WP_044674937 | 278 | LLGKIGDDYADLFIATKSLYDGILLAGILSTDSTTKAPLSSSMVNRYEEHKKDLALLKNFIHQN-LSDSYKEVENDKLK | 356 |
| WP_044676715 | 278 | LLGKIGDDYADLFIATKSLYDGILLAGILSTTDSTTKAPLSSSMVNRYEEHQKDLALLKNFIHQN-LSDSYKEVENDKLK | 356 |
| WP_044680361 | 278 | LLGKIGDDYADLFIATKSLYDGILLAGILSTTDSTTKAPLSSSMVNRYEEHQKDLALLKNFIHQN-LSDSYKEVENDKLK | 356 |
| WP_044681799 | 278 | LLGKIGDDYADLFIATKSLYDGILLAGILSTTDSTTKAPLSSSMVNRYEEHQKDLALLKNFIHQN-LSDSYKEVENDKLK | 356 |
| WP_049533112 | 278 | LLGEIGDEYADLFRASAKNLYDAILLDESMDGYEYFA----EAKKESYRKHQEELVLVKKMLKSNaITNDERAKF---EY | 356 |
| WP_029090905 | 244 | LADVLADEYDLLLTAQKIYSAIILDESMDGYEYFA----EAKKESYRKHQEELVLVKKMLKSNaITNDERAKF---EY | 315 |
| WP_006506696 | 284 | VEKDLGE-YVEFVDALHNVYSWVELQTIMGATHTD-NASISEAMVSRYNKHHDDLKLLKDCIKNN-VPNKYFDMFRNDSE | 360 |
| AIT42264 | 278 | LLAQIGDQYADLFLAAKNLSDAILLSDILRVNTEITKAPLSASMIKRYDEHHQDLTLLKALVRQQ-LPEKYKEIFFDQSK | 356 |
| WP_034440723 | 284 | LLSNIDEGYRDVFLQAKNVYNAIELSKILKTDGKETKAPLSASMIKRYDEHHQNHREDLKKYKDYIKAY-LPEKYEIFFDQSK | 362 |
| AKQ21048 | 278 | LLAQIGDQYADLFLAAKNLSDAILLSDILRVNTEITKAPLSASMIKRYDEHHQDLTLLKALVRQQ-LPEKYKEIFFDQSK | 356 |
| WP_004636532 | 277 | LLGMTDDVFLDVFMAAKNVYDAVEMSAIISTDFGNSKAVLSNQMINFYDEHKVDLAQLKQFFKTH-LPDKYECFSDPSK | 355 |
| WP_002364836 | 284 | ILAKVGDEYSDVFLAAKNVYDAVELSTILADSDKKSHAKLSSSMIVRFTEHQEDLKKFKRFIREN-CPDEYDNLFKNEQK | 362 |
| WP_016631044 | 235 | ILAKVGDEYSDVFLAAKNVYDAVELSTILADSDKKSHAKLSSSMIVRFTEHQEDLKKFKRFIREN-CPDEYDNLFKNEQK | 313 |
| EMS75795 | 21 | LLEKSGEEFRDVFLQAKKVYDAVLLSDILSTKKQNSKAKLSLGMIERYDSHKKDLEELKQFVKAN-LPEKTAIFFKDSSK | 99 |
| WP_002373311 | 284 | ILAKVGDEYSDVFLAAKNVYDAVELSTILADSDKKSHAKLSSSMIVRFTEHQEDLKKFKRFIREN-CPDEYDNLFKNEQK | 362 |
| WP_002378009 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002407324 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002413717 | 286 | ILAKVGDEYSDVFLAAKNVYDAVELSTILADSDKKSHAKLSSSMIVRFTEHQEDLKNFKRFIREN-CPDEYDNLFKNEQK | 364 |
| WP_010775580 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_010818269 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_010824395 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_016622645 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_033624816 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_033625576 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_033789179 | 284 | ILAKVGDEYSDVFLAAKNVYDAVELSTILADSDKKSHAKLSSSMIVRFTEHQEDLKNFKRFIREN-CPDEYDNLFKNEQK | 362 |
| WP_002310644 | 282 | LLEKIGDYIDLFVQAKNVYDAVLLSEILSDSTKNTRAKLSAGMIRRYDAHKEDLVLLKRFVKEN-LPKKYRAFFGDNSV | 361 |
| WP_002312694 | 283 | LLEKIGDYIDLFVQAKNVYDAVLLSEILSDSTKNTRAKLSAGMIRRYDAHKEDLVLLKRFVKEN-LPKKYRAFFGDNSV | 361 |
| WP_002314015 | 283 | LLEKIGDYIDLFVQAKNVYDAVLLSEILSDSTKNTRAKLSAGMIRRYDAHKEDLVLLKRFVKEN-LPKKYRAFFGDNSV | 361 |
| WP_002320716 | 283 | LLEKIGDYIDLFVQAKNVYDAVLLSEILSDSTKNTRAKLSAGMIRRYDAHKEDLVLLKRFVKEN-LPKKYRAFFGDNSV | 361 |
| WP_002330729 | 282 | LLEKIGDYIDLFVQAKNVYDAVLLSEILSDSTKNTRAKLSAGMIRRYDAHKEDLVLLKRFVKEN-LPKKYRAFFGDNSV | 360 |
| WP_002335161 | 283 | LLEKIGDYIDLFVQAKNVYDAVLLSEILSDSTKNTRAKLSAGMIRRYDAHKEDLVLLKRFVKEN-LPKKYRAFFGDNSV | 361 |

```
-continued

WP_002345439   283  LLEKIGDDYIDLFVQAKNVYDAVLLSEILSDSTKNTRAKLSAGMIRRYDAHKEDLVLLKRFVKEN-LPKKYRAFFGDNSV            361
WP_034867970   276  LLEKIGDEYLDIFLQAKKVHDAILLSEIISSTVKHTKAKLSSGMVERYERHKADLAKFKQFVKEN-VPQKATVFFKDTTK            354
WP_047937432   283  LLEKIGDEYLDIFLQAKKVHDAILLSEIISSTVKHTKAKLSSGMVERYERHKADLAKFKQFVKEN-VPQKATVFFKDTTK            361
WP_010720994   276  LLEKIGDEYLDIFLQAKKVHDAILLSEIISSTVKHTKAKLSSGMVERYERHKADLAKFKQFVKEN-VPQKATVFFKDTTK            354
WP_010737004   276  LLEKIGDEYLDIFLQAKKVHDAILLSEIISSTVKHTKAKLSSGMVERYERHKADLAKFKQFVKEN-VPQKATVFFKDTTK            354
WP_034700478   276  LLEKIGDEYLDIFLQAKKVHDAILLSEIISSTVKHTKAKLSSGMVERYERHKADLAKFKQFVKEN-VPQKATVFFKDTTK            354
WP_007209003   281  LLAIIGDEYGDIFVAAQNLYQAILLAGILTSTEK-TRAKLSASMIQRYEEHAKDLKLLKRFVKEH-IPDKYAEIFNDATK            358
WP_023519017   276  LLEKTSDDYAELFLKAKGVYDAILLSQIILSKSDDETKAKLSANMKLRFEEHQRDLKQLKELVRRD-LPKKYDDFFKNRSK           354
WP_010770040   279  LLAIIGDEYAEIFSATKSVYDAVLSGILSVTDGDTKAKLSASMVERYEAHQKDLVQFKQFIRKE-LPEMYAPIFRDNSV             357
WP_048604708   275  LLGEIGDEYADVFEAAKNVYNAELLVDLLSEII--TTMDDSTKAKLSAGMIKRYEDHKTDLKLFKEFIRKNL-LPEKYHEIFNDKNT    353
WP_010750235   276  LLRKSNEEMIDVFLQVKKVYDAILLSDILSTKMDDTKAKLSAGMIERYQNHKKDLEELKQFVRAH-LHEKYTVFFKDSSK            354
AII16583       317  LLAAIGDEYADLFLAAKNLSDAILLSDILRVNTEITKAPLSAGMIKRYDEHHQDLTLLKALVRQQ-LPEKYEIFFDQSK             395
WP_029073316   290  KQPLLGD--CVEFIDLLHDIYSWWELQNILGSAHTS-EPSISAAMIQRYEDHKNDLKLLKDVIRKY-LPKKYFEVFRDEKS            366
WP_031589969   290  KQPLLGD--CVEFIDLLHDIYSWWELQNILGSAHTS-EPSISAAMIQRYEDHKNDLKLLKDVIRKY-LPKKYFEVFRDEKS            366
KDA45870       276  LLAEADQYLDIFVAAKLVDRAILLASILDVKDTQTKTVFSQAMIERYEEHQDLIELKRVFKKY-LPEKCHDFFSE-PK             353
WP_039099354   286  LESSLDDNAHQIIESLQELYSGVLLAGIVPENQSLS----QAMITKYDDHQKHLKMLKAVREAL-APEDRQRLKQAYDQ            359
AKP02966       279  LDSILDDDQFTVLDTANRIYSTITLNEIL-----NGESYFSMAKVNQYENHAIDLCKLRDMWHTT----KNEKAV-GLSR           348
WP_010991369   284  LLALIGDEYAELFVAAKNAYSAVVLSSIITVAETETNAKLSASMIERPDTHEEDLGELKAFIKLH-LPKHYEIFSNTEK            362
WP_033838504   284  LLALIGDEYAELFVAAKNAYSAVVLSSIITVAETETNAKLSASMIERPDTHEEDLGELKAFIKLH-LPKHYEIFSNTEK            362
EHN60060       287  LLALIGDEYAELFVAAKNAYSAVVLSSIITVAETETNAKLSASMIERPDTHEEDLGELKAFIKLH-LPKHYEIFSNTEK            365
EFR89594        53  LLAKIGDEYAELFVAAKSTYNAVAVLSNIITVDTETKAKLSASMIERPDKHAKDLKRLKAFFKMQ-LPKFNEVFNDIEK            131
WP_038409211   284  LLAKIGDEYAELFVAAKSTYNAVAVLSNIITVDTETKAKLSASMIERPDKHAKDLKRLKAFFKMQ-LPKFNEVFNDIEK            362
EFR95520       
WP_003723650   284  LLAIIGDEYAELFVAAKNTYNAVNLSSIITVDTETNAKLSASMIERPDAHEKDLVELKAFIKLN-LPKQYEIFSNAAI             362
WP_003727705   284  LLAIIGDEYAELFVAAKNTYNAVNLSSIITVDTETATETNAKLSASMIERPDAHEKELGELKAFIKLH-LPKQYQEIFNNAEI        362
WP_003730785   284  LLAIIGDEYAELFVAAKNTYNAVNLSSIITVDTETATETNAKLSASMIERPDAHEKELGELKAFIKLH-LPKQYQEIFNNAEI        362
WP_003733029   284  LLAIIGDEFAEVFVAAKNAYNAVNLSNIITVDSTTRAKLSASLIERPENNHKEDLKKMKRFVRTY-LPKKYDEIFDDTEK           362
WP_014601172   284  LLAIIGDEYAELFVAAKNTYNAVNLSSIITVDTETNAKLSASMIERPDAHEKDLSELKAFIKLH-LPKQYQEIFSNVAI            362
WP_023548323   284  LLAIIGDEYAELFVAAKNTYNAVNLSSIITVDTETATETNAKLSASMIERPDAHEKDLGELKAFIKLH-LPKQYQEIFSNAAI        362
WP_031665337   284  LLAIIGDEYAELFVAAKNTYNAVNLSSIITVDTETNAKLSASMIERPDAHEKDLVELKAFIKLN-LPKQYEIFSNAAI             362
WP_031669209   284  LLAIIGDEYAELFVAAKNAYNAVNLSNIITVDTSTTRAKLSASLIERPENNHKEDLKKMKRFVRTY-LPKKYDEIFDDTEK          362
WP_033920898   284  LLAIIGDEYAELFVAAKNTYNAVNLSSIITVDTETNAKLSASMIERPDAHEKDLVELKAFIKLN-LPKQYEIFSNAAI             362
AKI42028       287  LLAIIGDEYAELFVAAKNTYNAVNLSSIITVDTETNAKLSASMIERPDAHEKDLVELKAFIKLN-LPKQYEIFSNAAI             365
AKI50529       287  LLAIIGDEYAELFVAAKNTYNAVNLSSIITVDTETNAKLSASMIERPDAHEKDLVELKAFIKLN-LPKQYEIFSNAAI             365
EFR83390            
WP_046323366   284  LLARVGDEYAEIFVAAKNAYNAYNLSSIITVSNTETKAKLSASMIKRYDEHHQDLKRMKAFFKVR-LPENFNEVFNDVEK           362
AKE81011       294  LLAAIGDQYADLFLAAKNLSDAILLSDILRVNTEITKAPLSASMIKRYDEHHQDLTLLKALVRQQ-LPEKYKEIFFDQSK           372
CUO82355       288  VENDLGE--YVEFIDSLHNIYSWWELQIMGATHTD-NPSISEAMVSRYNKHHEDLQLLKKCIKDN-VPKKYFDMFRNDSE            364
WP_033162887   289  LQSELGE--YIEFIEMLHNIYSWWELQALIGATHTD-NPSISAAMVERYEEHKKDLRVLKKVIREE-LPDKYNEVFRKDNR           365
AGZ01981       311  LLAQIGDQYADLFLAAKNLSDAILLSDILRVNTEITKAPLSASMIKRYDEHHQDLTLLKALVRQQ-LPEKYKEIFFDQSK           389
AKA60242       278  LLAQIGDQYADLFLAAKNLSDAILLSDILRVNTEITKAPLSASMIKRYDEHHQDLTLLKALVRQQ-LPEKYKEIFFDQSK           356
AKS40380       278  LLAQIGDQYADLFLAAKNLSDAILLSDILRVNTEITKAPLSASMIKRYDEHHQDLTLLKALVRQQ-LPEKYKEIFFDQSK           356
4UN5_B         282  LLAQIGDQYADLFLAAKNLSDAILLSDILRVNTEITKAPLSASMIKRYDEHHQDLTLLKALVRQQ-LPEKYKEIFFDQSK           360

WP_010922251   357  --NGYAG  YIDG  G  ASQEEFYKFIKPILEL-M--DGTEELLv--KLNREDLLRKQRTFDNG[S]IPHQIHLGEL             419

WP_039695303   358  --NGYAG  YIEN  G  VKQDEFYKYLKNILSK-IkiDGSDYFL--DKIEREDFLRKQRTFDNGSIPHQIHLQEM               422
WP_045635197   357  --DGYAG  YIDG  K  TTQETFYKYIKNLLSK-F--EGTDYFL--DKIEREDFLRKQRTFDNGSIPHQIHLQEM               419
5AXW_A         169  SINR         -  -----------------K---TSDYVk----------------EA                              183
WP_009880683    41  --NGYAG  YIDG  G  ASQEEFYKFIKPILEK-M--DGTEELLa--KLNREDLLRKQRTFDNGSIPHQIHLGEL               103
WP_010922251   357  --NGYAG  YIDG  G  ASQEEFYKFIKPILEK-M--DGTEELLv--KLNREDLLRKQRTFDNGSIPHQIHLGEL               419
```

-continued

```
WP_011054416    357 -NGYAG YIDG G ASQEBFYKFIKPILEK-M--DGTEELLa--KLNREDLLRKQRTFDNGSIPYQIHLGEL 419
WP_011284745    357 -NGYAG YIDG G ASQDEFYKFIKPILEK-M--DGTEELLa--KLNREDLLRKQRTFDNGSIPHQIHLGEL 419
WP_011285506    357 -NGYAG YIDG G ASQREFYKFIKPILEK-M--DGTEELLa--KLNREDLLRKQRTFDNGSIPHQIHLGEL 419
WP_011527619    357 -NGYAG YIDG G ASQREFYKFIKPILEK-M--DGTEELLv--KLNREDLLRKQRTFDNGSIPHQIHLGEL 419
WP_012560673    357 -NGYAG YIDG G ASQREFYKFIKPILEK-M--DGTEELLa--KLNREDLLRKQRTFDNGSIPHQIHLGEL 419
WP_014407541    357 -NGYAG YIDG G ASQREFYKFIKPILEK-M--DGTEELLa--KLNREDLLRKQRTFDNGSIPHQIHLGEL 419
WP_020905136    357 -NGYAG YIDG G ASQREFYKFIKPILEK-M--DGTEELLa--KLNREDLLRKQRTFDNGSIPHQIHLGEL 419
WP_023080005    357 -NGYAG YIDG G ASQREFYKFIKPILEK-M--DGTEELLa--KLNREDLLRKQRTFDNGSIPHQIHLGEL 419
WP_023610282    357 -NGYAG YIDG G ASQREFYKFIKPILEK-M--DGTEELLa--KLNREDLLRKQRTFDNGSIPYQIHLGEL 419
WP_030125963    357 -NGYAG YIDG G ASQREFYKFIKPILEK-M--DGTEELLv--KLNREDLLRKQRTFDNGSIPHQIHLGEL 419
WP_030126706    357 -NGYAG YIDG G ASQREFYKFIKPILEK-M--DGTEELLa--KLNREDLLRKQRTFDNGSIPYQIHLGEL 419
WP_031488318    357 -NGYAG YIDG G ASQREFYKFIKPILEK-M--DGTEELLa--KLNREDLLRKQRTFDNGSIPHQIHLGEL 419
WP_032460140    357 -NGYAG YIDG G ASQREFYKFIKPILEK-M--DGTEELLa--KLNREDLLRKQRTFDNGSIPHQIHLGEL 419
WP_032461047    357 -NGYAG YIDG G ASQREFYKFIKPILEK-M--DGTEELLa--KLNREDLLRKQRTFDNGSIPHQIHLGEL 419
WP_032462016    357 -NGYAG YIDG G ASQREFYKFIKPILEK-M--DGTEELLa--KLNREDLLRKQRTFDNGSIPHQIHLGEL 419
WP_032462936    357 -NGYAG YIDG G ASQREFYKFIKPILEK-M--DGTEELLa--KLNREDLLRKQRTFDNGSIPHQIHLGEL 419
WP_032464890    357 -NGYAG YIDG G ASQREFYKFIKPILEK-M--DGTEELLa--KLNREDLLRKQRTFDNGSIPHQIHLGEL 419
WP_033888930    182 -NGYAG YIDG G ASQREFYKFIKPILEK-M--DGTEELLv--KLNRKDLLRKQRTFDNGSIPHQIHLGEL 244
WP_038431314    357 -NGYAG YIDG G ASQREFYKFIKPILEK-M--DGTEELLa--KLNREDLLRKQRTFDNGSIPHQIHLGEL 419
WP_038432938    357 -NGYAG YIDG G ASQREFYKFIKPILEK-M--DGTEELLa--KLNREDLLRKQRTFDNGSIPYQIHLGEL 419
WP_038434062    357 -NGYAG YIDG G ASQREFYKFIKPILEK-M--DGTEELLv--KLNREDLLRKQRTFDNGSIPHQIHLGEL 419
BAQ51233        268 -NGYAG YIDG G ASQREFYKFIKPILEK-M--DGTEELLa--KLNREDLLRKQRTFDNGSIPHQIHLGEL 330
KGE60856            ----- ---- - ------------------------------------------------------- 
KGE60162        357 -NGYAG YIDG G ASQREFYKFILKGILLQ-I--NGSGDFL--DKIDREDFLRKQRTFDNGSIPHQIHLQEM 419
WP_002989955    357 -KGYAG YIEN G VKQDEFYKYLKNTLSK-Ia--GSDYFL--DKIEREDFLRKQRTFDNGSIPHQIHLQEM 419
WP_003030002    360 -NGYAG YIEN G VKQDEFYKYLKNTLSK-Ia--GSDYFL--DKIEREDFLRKQRTFDNGSIPHQIHLQEM 422
WP_003065552    358 -DGYAG YIEG K TNQEAFYKYLSKLLTK-Q--EGSEYFL--EDSENFL--EKIKNEDFLRKQRTFDNGSIPHQVHLTEL 420
WP_001040076    358 -DGYAG YIEG K TNQEAFYKYLSKLLTK-Q--EGSEYFL--EDSENFL--EKIKNEDFLRKQRTFDNGSIPHQVHLTEL 420
WP_001040078    358 -DGYAG YIEG K TNQEAFYKYLSKLLTK-Q--EGSEYFL--EDSENFL--EKIKNEDFLRKQRTFDNGSIPHQVHLTEL 420
WP_001040080    358 -DGYAG YIEG K TNQEAFYKYLSKLLTK-Q--EGSEYFL--EDSENFL--EKIKNEDFLRKQRTFDNGSIPHQVHLTEL 420
WP_001040081    358 -DGYAG YIEG K TNQEAFYKYLSKLLTK-Q--EGSEYFL--EDSENFL--EKIKNEDFLRKQRTFDNGSIPHQVHLTEL 420
WP_001040083    358 -DGYAG YIEG K TNQEAFYKYLSKLLTK-Q--EGSEYLL--EDSENFL--EKIKNEDFLRKQRTFDNGSIPHQVHLTEL 420
WP_001040085    358 -DGYAG YIEG K TNQEAFYKYLSKLLTK-Q--EGSEYLL--EDSENFL--EKIKNEDFLRKQRTFDNGSIPHQVHLTEL 420
WP_001040087    358 -DGYAG YIEG K TNQEAFYKYLSKLLTK-Q--EGSEYLL--EDSENFL--EKIKNEDFLRKQRTFDNGSIPHQVHLTEL 420
WP_001040088    358 -DGYAG YIEG K TNQEAFYKYLSKLLTK-Q--EGSEYLL--EDSENFL--EKIKNEDFLRKQRTFDNGSIPHQVHLTEL 420
WP_001040089    358 -DGYAG YIEG K TNQEAFYKYLSKLLTK-Q--EGSEYLL--EDSENFL--EKIKNEDFLRKQRTFDNGSIPHQVHLTEL 420
WP_001040090    358 -DGYAG YIEG K TNQEAFYKYLSKLLTK-Q--EGSEYLL--EDSENFL--EKIKNEDFLRKQRTFDNGSIPHQVHLTEL 420
WP_001040091    358 -DGYAG YIEG K TNQEAFYKYLSKLLTK-Q--EGSEYLL--EDSENFL--EKIKNEDFLRKQRTFDNGSIPHQVHLTEL 420
WP_001040092    358 -DGYAG YIEG K TNQEAFYKYLSKLLTK-Q--EGSEYLL--EDSENFL--EKIKNEDFLRKQRTFDNGSIPHQVHLTEL 420
WP_001040094    358 -DGYAG YIEG K TNQEAFYKYLSKLLTK-Q--EGSEYLL--EDSENFL--EKIKNEDFLRKQRTFDNGSIPHQVHLTEL 420
WP_001040095    358 -DGYAG YIEG K TNQEAFYKYLSKLLTK-Q--EGSEYLL--EDSENFL--EKIKNEDFLRKQRTFDNGSIPHQVHLTEL 420
WP_001040096    358 -DGYAG YIEG K TNQEAFYKYLSKLLTK-Q--EGSEYLL--EDSENFL--EKIKNEDFLRKQRTFDNGSIPHQVHLTEL 420
WP_001040097    358 -DGYAG YIEG K TNQEAFYKYLSKLLTK-Q--EGSEYLL--EDSENFL--EKIKNEDFLRKQRTFDNGSIPHQVHLTEL 420
WP_001040098    358 -DGYAG YIEG K TNQEAFYKYLSKLLTK-Q--EGSEYLL--EDSENFL--EKIKNEDFLRKQRTFDNGSIPHQVHLTEL 420
WP_001040099    358 -DGYAG YIEG K TNQEAFYKYLSKLLTK-Q--EGSEYLL--EDSENFL--EKIKNEDFLRKQRTFDNGSIPHQVHLTEL 420
WP_001040100    358 -DGYAG YIEG K TNQEAFYKYLSKLLTK-Q--EGSEYLL--EDSENFL--EKIKNEDFLRKQRTFDNGSIPHQVHLTEL 420
WP_001040104    358 -DGYAG YIEG K TNQEAFYKYLSKLLTK-Q--EGSEYLL--EDSENFL--EKIKNEDFLRKQRTFDNGSIPHQVHLTEL 420
WP_001040105    358 -DGYAG YIEG K TNQEAFYKYLSKLLTK-Q--EGSEYLL--EDSENFL--EKIKNEDFLRKQRTFDNGSIPHQVHLTEL 420
WP_001040106    358 -DGYAG YIEG K TNQEAFYKYLSKLLTK-Q--EGSEYFL--EDSEYFL--EKIKNEDFLRKQRTFDNGSIPHQVHLTEL 420
WP_001040107    358 -DGYAG YIEG K TNQEAFYKYLSKLLTK-Q--EGSEYFL--EDSEYFL--EKIKNEDFLRKQRTFDNGSIPHQVHLTEL 420
WP_001040108    358 -DGYAG YIEG K TNQGAFYKYLSKLLTK-Q--EGSEYFL--EDSEYFL--EKIKNEDFLRKQRTFDNGSIPHQVHLTEL 420
WP_001040109    358 -DGYAG YIEG K TNQGAFYKYLSKLLTK-Q--EGSEYFL--EDSEYFL--EKIKNEDFLRKQRTFDNGSIPHQVHLTEL 420
WP_001040110    358 -DGYAG YIEG K TNQGAFYKYLSKLLTK-Q--EGSEYFL--EDSEYFL--EKIKNEDFLRKQRTFDNGSIPHQVHLTEL 420
```

-continued

| | | | | | | |
|---|---|---|---|---|---|---|
| WP_015058523 | 358 | --DGYAG | YIEG | K | TNQEAFYKYLSKLLTK-Q--EDSEYFL--EKIKNEDFLRKQRTFDNGSIPHQVHLTEL | 420 |
| WP_017643650 | 358 | --DGYAG | YIEG | K | TNQEAFYKYLSKLLTK-Q--EGSEYLL--EKIKNEDFLRKQRTFDNGSIPHQVHLTEL | 420 |
| WP_017647151 | 358 | --DGYAG | YIEG | K | TNQGAFYKYLSKLLTK-Q--EGSEYFL--EKIKNEDFLRKQRTFDNGSIPHQVHLTEL | 420 |
| WP_017648376 | 358 | --DGYAG | YIEG | K | TNQGAFYKYLSKLLTK-Q--EGSEYFL--EKIKNEDFLRKQRTFDNGSIPHQVHLTEL | 420 |
| WP_017649527 | 358 | --DGYAG | YIEG | K | TNQEAFYKYLSKLLTK-Q--EDSENFL--EKIKNEDFLRKQRTFDNGSIPHQVHLTEL | 420 |
| WP_017771611 | 358 | --DGYAG | YIEG | K | TNQGAFYKYLSKLLTK-Q--EGSEYFL--EKIKNEDFLRKQRTFDNGSIPHQVHLTEL | 420 |
| WP_017771984 | 358 | --DGYAG | YIEG | K | TNQEAFYKYLSKLLTK-Q--EDSENFL--EKIKNEDFLRKQRTFDNGSIPHQVHLTEL | 420 |
| CFQ25032 | 358 | --DGYAG | YIEG | K | TNQEAFYKYLSKLLTK-Q--EDSENFL--EKIKNEDFLRKQRTFDNGSIPHQVHLTEL | 420 |
| CFV16040 | 358 | --DGYAG | YIEG | K | TNQEAFYKYLSKLLTK-Q--EDSENFL--EKIKNEDFLRKQRTFDNGSIPHQVHLTEL | 420 |
| KLJ37842 | 358 | --DGYAG | YIEG | K | TNQEAFYKYLSKLLTK-Q--EDSENFL--EKIKNEDFLRKQRTFDNGSIPHQVHLTEL | 420 |
| KLJ72361 | 358 | --DGYAG | YIEG | K | TNQEAFYKYLSKLLTK-Q--EDSENFL--EKIKNEDFLRKQRTFDNGSIPHQVHLTEL | 420 |
| KLL20707 | 358 | --DGYAG | YIEG | K | TNQEAFYKYLSKLLTK-Q--EDSENFL--EKIKNEDFLRKQRTFDNGSIPHQVHLTEL | 420 |
| KLL42645 | 358 | --DGYAG | YIEG | K | TNQGAFYKYLSKLLTK-Q--EGSEYFL--EKIKNEDFLRKQRTFDNGSIPHQVHLTEL | 420 |
| WP_047207273 | 358 | --DGYAG | YIEG | K | TNQEAFYKYLSKLLTK-Q--EDSENFL--EKIKNEDFLRKQRTFDNGSIPHQVHLTEL | 420 |
| WP_047209694 | 358 | --DGYAG | YIEG | K | TNQEAFYKYLSKLLTK-Q--EGSEYLL--EKIKNEDFLRKQRTFDNGSIPHQVHLTEL | 420 |
| WP_050198062 | 358 | --DGYAG | YIEG | K | TNQEAFYKYLSKLLTK-Q--EDSENFL--EKIKNEDFLRKQRTFDNGSIPHQVHLTEL | 420 |
| WP_050201642 | 358 | --DGYAG | YIEG | K | TNQEAFYKYLSKLLTK-Q--EDSENFL--EKIKNEDFLRKQRTFDNGSIPHQVHLTEL | 420 |
| WP_050204027 | 358 | --DGYAG | YIES | K | TNQGAFYKYLSKLLTK-Q--EGSEYFL--EKIKNEDFLRKQRTFDNGSIPHQVHLTEL | 420 |
| WP_050881965 | 358 | --DGYAG | YIEG | K | TNQEAFYKYLSKLLTK-Q--EDSENFL--EKIKNEDFLRKQRTFDNGSIPHQVHLTEL | 420 |
| WP_050886065 | 358 | --DGYAG | YIEG | K | TNQEAFYKYLSKLLTK-Q--EDSENFL--EKIKNEDFLRKQRTFDNGSIPHQVHLTEL | 420 |
| AHN30376 | 358 | --DGYAG | YIEG | K | TNQEAFYKYLSKLLTK-Q--EDSEYFL--EKIKNEDFLRKQRTFDNGSIPHQVHLTEL | 420 |
| EA078426 | 358 | --DGYAG | YIEG | K | TNQEAFYKYLSKLLTK-Q--EDSENFL--EKIKNEDFLRKQRTFDNGSIPHQVHLTEL | 420 |
| CCW42055 | 358 | --DGYAG | YIEG | K | TNQEAFYKYLSKLLTK-Q--EGSEYLL--EKIKNEDFLRKQRTFDNGSIPHQVHLTEL | 420 |
| WP_003041502 | 357 | --KGYAG | YIES | G | VKQDEFYKYLKGILLQ-I--NGSGDFL--DKIDREDFLRKQRTFDNGSIPHQIHLQEM | 419 |
| WP_037593752 | 358 | --KGYAG | YIES | G | VEQDEFYKYLKGILLK-I--NGSGDFL--DKIDCEDFLRKQRTFDNGSIPHQIHLQEM | 420 |
| WP_049516684 | 358 | --NGYAG | YIEN | G | VKQDEFYKYLKNTLSK-I--DGSDYFL--DKIDREDFLRKQRTFDNGSIPHQIHLQEM | 420 |
| GAD46167 | 357 | --KGYAG | YIES | G | VEQDEFYKYLKGILLK-I--NGSGDFL--DKIDCEDFLRKQRTFDNGSIPHQIHLQEM | 419 |
| WP_018363470 | 358 | --NGYAG | YIEN | G | VKQDEFYKYLKGILTK-I--NGSDYFL--DKIEREDFLRKQRTFDNGSIPHQIHLQEM | 420 |
| WP_003043819 | 357 | --NGYAG | YVGI | G | ATQEEFYKFIKPILEK-M--DGAEELLa--KLNRDDLLRKQRTFDNGSIPHQIHLKEL | 429 |
| WP_006269658 | 357 | --KGYAS | YIES | G | VKQDEFYKYLKGILLK-I--NGSGDFL--DKIDREDFLRKQRTFDNGSIPHQIHLQEM | 419 |
| WP_048800889 | 357 | --NGYAG | YIEN | G | VKQDEFYKYLKNTLSK-I--DGSGYFL--DKIEREDFLRKQRTFDNGSIPHQIHLQEM | 419 |
| WP_012767106 | 357 | --NGYAG | YIDG | G | ASQEEFYKFIKPILEK-M--DGTEELLa--KLNREDLLRKQRTFDNGSIPHQIHLGEL | 419 |
| WP_014612333 | 357 | --NGYAG | YIDG | G | ASQEEFYKFIKPILEK-M--DGTEELLa--KLNREDLLRKQRTFDNGSIPHQIHLGEL | 419 |
| WP_015017095 | 357 | --NGYAG | YIDG | G | ASQEEFYKFIKPILEK-M--DGTEELLa--KLNREDLLRKQRTFDNGSIPHQIHLGEL | 419 |
| WP_015057649 | 357 | --NGYAG | YIDG | G | ASQEEFYKFIKPILEK-M--DGTEELLa--KLNREDLLRKQRTFDNGSIPHQIHLGEL | 419 |
| WP_048327215 | 357 | --NGYAG | YIDG | G | ASQEEFYKFIKPILEK-M--DGTEELLa--KLNREDLLRKQRTFDNGSIPHQIHLGEL | 419 |
| WP_049519324 | 357 | --NGYAG | YIDG | G | ASQEEFYKFIKPILEK-M--DGTEELLa--KLNREDLLRKQRTFDNGSIPHQIHLGEL | 419 |
| WP_012515931 | 357 | --NGYAG | YIEG | Q | VSQEEFYKYLKPILAR-L--DGSEPLLl--KIDREDFLRKQRTFDNGSIPHQIHLEEL | 419 |
| WP_021320964 | 357 | --NGYAG | YIEG | Q | VSQEEFYKYLKPILAR-L--DGSEPLLl--KIDREDFLRKQRTFDNGSIPHQIHLEEL | 419 |
| WP_037581760 | 357 | --NGYAG | YIEG | Q | VSQEEFYKYLKPILAR-L--DGSEPLLl--KIDREDFLRKQRTFDNGSIPHQIHLEEL | 419 |
| WP_004232481 | 357 | --NGYAG | YIEN | G | VKQDIFYKHLKSIISE-K--NGGQYFL--DKIEREDFLRKQRTFDNGSIPYQIHLQEM | 419 |
| WP_009854540 | 358 | --NGYAG | YIEN | G | VKQDEFYKYLKNTLSK-I--DGSDYFL--DKIEREDFLRKQRTFDNGSIPHQIHLQEM | 420 |
| WP_012962174 | 358 | --NGYAG | YIEN | G | VKQDEFYKYLKTTLSK-I--DGSDYFL--DKIEREDFLRKQRTFDNGSIPHQIHLQEM | 420 |
| WP_039695303 | 358 | --NGYAG | YIEN | G | VKQDEFYKYLKNILSK-IkiDGSDYFL--DKIEREDFLRKQRTFDNGSIPHQIHLQEM | 422 |
| WP_014334983 | 357 | --NGYAG | YIDN | G | VKQDEFYKYLKTILTK-I--DDSDYFL--DKIERDDFLRKQRTFDNGSIPHQIHLQEM | 419 |
| WP_003099269 | 357 | --NGYAG | YIDG | K | TSQEEFYKYIKPILLK-L--DGTEKLIs--KLEREDFLRKQRTFDNGSIPHQIHLNEL | 419 |
| AHY15608 | 357 | --NGYAG | YIDG | K | TSQEEFYKYIKPILLK-L--DGTEKLIs--KLEREDFLRKQRTFDNGSIPHQIHLNEL | 419 |
| AHY17476 | 357 | --NGYAG | YIDG | K | TSQEEFYKYIKPILLK-L--DGTEKLIs--KLEREDFLRKQRTFDNGSIPHQIHLNEL | 419 |
| ESR09100 | | ------- | ---- | - | ---------------------------------------------------------- | |
| AGM98575 | 357 | --NGYAG | YIDG | K | TSQEEFYKYIKPILLK-L--DGTEKLIs--KLEREDFLRKQRTFDNGSIPHQIHLNEL | 419 |
| ALF27331 | 357 | --DGYAG | YIDG | K | TNQEAFYKYLKGLLNK-I--EGSGYFL--DKIEREDFLRKQRTFDNGSIPHQIHLQEM | 419 |
| WP_018372492 | 355 | --PSYAA | YVSG | A | VTEDDFYKFSKGLLID-V--EGAEYFL--EKIEREDFLRKQRTFDNGAIPNQVHVKEL | 432 |
| WP_045618028 | 358 | --DGYAG | YIDG | K | TTQEAFYKYIKNLLSK-L--EGADYFL--DKIEREDFLRKQRTFDNGSIPHQIHLQEM | 420 |

```
-continued

WP_045635197  357 --DGYAG YIDG K TTQETFYKYIKNLLSK-F--EGTDYFL--DKIEREDFLRKQRTFDNGSIPHQIHLQEM 419
WP_002263549  357 --DGYAG YIDG K TNQEAFYKYIKGLLNK-I--EGSGYFL--DKIEREDFLRKQRTFDNGSIPHQIHLQEM 419
WP_002263887  357 --DGYAG YIDG K TNQEAFYKYILKGLLNK-I--EGSGYFL--DKIEREDFLRKQRTFDNGSIPHQIHLQEM 419
WP_002264920  357 --NGYAG YIEN G VKQDEFYKYIKNTLSK-I--AGSDYFL--DKIEREDFLRKQRTFDNGSIPHQIHLQEM 419
WP_002269043  357 --DGYAG YIDG K TNQEAFYKYLKGLLNK-I--EGSGYFL--DKIEREDFLRKQRTFDNGSIPHQIHLQEM 419
WP_002269448  357 --DGYAG YIDG K TNQEAFYKYLKGLLNK-I--EGSGYFL--DKIEREDFLRKQRTFDNGSIPHQIHLQEM 419
WP_002271977  357 --DGYAG YIDG K TNQEAFYKYLKGLLNK-I--EGSGYFL--DKIEREDFLRKQRTFDNGSIPHQIHLQEM 419
WP_002272766  357 --DGYAG YIDG K TNQEAFYKYLKGLLNK-I--EGSGYFL--DKIEREDFLRKQRTFDNGSIPHQIHLQEM 419
WP_002273241  357 --DGYAG YIDG K TNQEAFYKYLKGLLNK-I--EGSGYFL--DKIEREDFLRKQRTFDNGSIPHQIHLQEM 419
WP_002275430  357 --DGYAG YIDG K TNQEAFYKYLKGLLNK-I--EGSGYFL--DKIEREDFLRKQRTFDNGSIPHQIHLQEM 419
WP_002276448  357 --DGYAG YIDG K TNQEAFYKYLKGLLNK-I--EGSGYFL--DKIEREDFLRKQRTFDNGSIPHQIHLQEM 419
WP_002277050  357 --NGYAG YIEN G VKQDEFYKYIKNTLSK-I--AGSDYFL--DKIEREDFLRKQRTFDNGSIPHQIHLQEM 419
WP_002277364  357 --DGYAG YIDG K TNQEAFYKYLKGLLNK-I--EGSGYFL--DKIEREDFLRKQRTFDNGSIPHQIHLQEM 419
WP_002279025  357 --DGYAG YIDG K TNQEAFYKYLKGLLNK-I--EGSGYFL--DKIEREDFLRKQRTFDNGSIPHQIHLQEM 419
WP_002279859  357 --DGYAG YIDG K TNQEAFYKYLKGLLNK-I--EGSGYFL--DKIEREDFLRKQRTFDNGSIPHQIHLQEM 419
WP_002280030  357 --DGYAG YIDG K TNQEAFYKYLKGLLNK-I--EGSGYFL--DKIEREDFLRKQRTFDNGSIPHQIHLQEM 419
WP_002281696  357 --DGYAG YIEN G VKQDEFYKYLKGLLNK-I--EGSGYFL--DKIEREDFLRKQRTFDNGSIPHQIHLQEM 419
WP_002282247  357 --NGYAG YIEN G TNQEAFYKYLKNTLSK-I--TGSDYFL--DQIEREDFLRKQRTFDNGSIPHQIHLQEM 419
WP_002282906  357 --DGYAG YIDG K TNQEAFYKYLKGLLNK-I--EGSGYFL--DKIEREDFLRKQRTFDNGSIPHQIHLQEM 419
WP_002283846  357 --DGYAG YIDG K TNQEAFYKYLKGLLNK-I--EGSGYFL--DKIEREDFLRKQRTFDNGSIPHQIHLQEM 419
WP_002287255  357 --DGYAG YIDG K TNQEAFYKYLKGLLNK-I--EGSGYFL--DKIEREDFLRKQRTFDNGSIPHQIHLQEM 419
WP_002288990  357 --DGYAG YIDG K TNQEAFYKYLKGLLNK-I--EGSGYFL--DKIEREDFLRKQRTFDNGSIPHQIHLQEM 419
WP_002289641  357 --DGYAG YIDG K TNQEAFYKYLKGLLNK-I--EGSGYFL--DKIEREDFLRKQRTFDNGSIPHQIHLQEM 419
WP_002290427  357 --DGYAG YIDG K TNQEAFYKYLKGLLNK-I--EGSGYFL--DKIEREDFLRKQRTFDNGSIPHQIHLQEM 419
WP_002295753  357 --DGYAG YIDG K TNQEAFYKYLKGLLNK-I--EGSGYFL--DKIEREDFLRKQRTFDNGSIPHQIHLQEM 419
WP_002296423  357 --DGYAG YIDG K TNQEAFYKYLKGLLNK-I--EGSGYFL--DKIEREDFLRKQRTFDNGSIPHQIHLQEM 419
WP_002304487  357 --NGYAG YVGA D ATEEEFYKYVKGILNK-V--EGADVWL--DKIDREDFLRKQRTFDNGSIPHQIHLQEM 429
WP_002305844  357 --DGYAG YIDG K TNQEAFYKYLKGLLNK-I--EGADWL---DKIEREDFLRKQRTFDNGSIPHQIHLQEM 419
WP_002307203  357 --NGYAG YIDG K TNQEAFYKYLKGLLNK-I--EGSGYFL--DKIEREDFLRKQRTFDNGSIPHQIHLQEM 419
WP_002310390  357 --DGYAG YIDG K TNQEAFYKYLKGLLNK-I--EGSGYFL--DKIEREDFLRKQRTFDNGSIPHQIHLQEM 419
WP_002352408  357 --DGYAG YIDG K TNQEAFYKYLKGLLNK-I--EGNGYFL--DKIEREDFLRKQRTFDNGSIPHQIHLQEM 419
WP_012997688  357 --DGYAG YIDG K TNQEAFYKYLKGLLNK-I--EGSGYFL--DKIEREDFLRKQRTFDNGSIPHQIHLQEM 419
WP_014677909  357 --DGYAG YIDG K TNQEAFYKYLKGLLNK-I--EGSGYFL--DKIEREDFLRKQRTFDNGSIPHQIHLQEM 419
WP_019312892  357 --DGYAG YIDG K TNQEAFYKYLKGLLNK-I--EGSGYFL--DQIEREDFLRKQRTFDNGSIPHQIHLQEM 419
WP_019313659  357 --DGYAG YIDG K TNQEAFYKYLKNTLSK-I--TGSDYFL--DKIEREDFLRKQRTFDNGSIPHQIHLQEM 419
WP_019314093  357 --NGYAG YIEN G VKQDEFYKYIKNTLSK-I--AGSDYFL--DKIEREDFLRKQRTFDNGSIPHQIHLQEM 419
WP_019315370  357 --DGYAG YIDG K TNQEAFYKYLKGLLNK-I--EGSGYFL--DKIEREDFLRKQRTFDNGSIPHQIHLQEM 419
WP_019803776  357 --DGYAG YIDG K TNQEAFYKYLKGLLNK-I--EGNGYFL--DKIEREDFLRKQRTFDNGSIPHQIHLQEM 419
WP_019805234  357 --NGYAG YIEN G VKQDEFYKYIKNTLSK-I--AGSDYFL--DKIEREDFLRKQRTFDNGSIPHQIHLQEM 419
WP_024783594  357 --DGYAG YIDG K TNQEAFYKYLKGLLNK-I--EGSGYFL--DKIEREDFLRKQRTFDNGSIPHQIHLQEM 419
WP_024784288  357 --NGYAG YIEN G VKQDEFYKYIKNTLSK-I--TGSDYFL--DQIEREDFLRKQRTFDNGSIPHQIHLQEM 419
WP_024784666  357 --DGYAG YIDG K TNQEAFYKYLKGLLNK-I--EGSGYFL--DKIEREDFLRKQRTFDNGSIPHQIHLQEM 419
WP_024784894  357 --NGYAG YIEN G VKQDEFYKYIKNTLSK-I--AGSDYFL--DKIEREDFLRKQRTFDNGSIPHQIHLQEM 419
WP_024786433  357 --NGYAG YIEN G VKQDEFYKYIKNTLSK-I--AGSDYFL--DKIEREDFLRKQRTFDNGSIPHQIHLQEM 419
WP_049473442  357 --DGYAG YIDG K TNQEAFYKYLKGLLNK-I--EGSGYFL--DKIEREDFLRKQRTFDNGSIPHQIHLQEM 419
WP_049474547  357 --DGYAG YIDG K TNQEAFYKYLKGLLNK-I--EGSGYFL--DKIEREDFLRKQRTFDNGSIPHQIHLQEM 419
EMC03581      350 --DGYAG YIDG K TSQDFYKYIKPILSK-L--KGAESLis--KLEREDFLRKQRTFDNGSIPHQIHLNEL 412
WP_000428612  358 --DGYAG YIDG K TSQEAFYKYIKPILET-L--DGAEDFLt--KINRREDFLRKQRTFDNGSIPHQIHLGEL 420
WP_000428613  358 --DGYAG YIDG K TTQEAFYKYIKNLLSK-F--EGTDYFL--EKIEREDFLRKQRTFDNGSIPHQIHLQEM 420
WP_049523028  357 --NGYAG YIDG K TNQEAFYKYIKNLISK-I--EGAEYFL--EKIEREDFLRKQRTFDNGSIPHQIHLQEM 419
WP_003107102  326 --DGYAG YING K TNQEAFYKYLKGLLNK-I--EGSGYFL--DKIEREDFLRKQRTFDNGSIPHQIHLQEM 388
WP_054279288  359 --DGYAG YISG K TSQEAFYKYIKPILET-L--DGADFLt---KINRREDFLRKQRTFDNGSIPHQIHLNEL 421
WP_049531101  358 --EGYAG YIDS K TTQEAFYKYIKNLLSK-I--DGADYLL--DKIEREDFLRKQRTFDNGSIPHQIHLQEM 420
```

| | | | | | |
|---|---|---|---|---|---|
| WP_049538452 | 358 | -DGYAG | YVDG | K | TTQEAFYKYIKNLLSK-F--EGADYFL--EKIEREDFLRKQRTFDNGSIPHQIIHLQEM | 420 |
| WP_049549711 | 358 | -DGYAG | YIDG | K | TTQEAFYKYIKNLLSK-F--EGTDYFL--EKIEREDFLRKQRTFDNGSIPHQIIHLQEM | 420 |
| WP_007896501 | 359 | -NGYAG | YIEG | K | VSQEDFYRYIKPILSR-L--KGGDEFLa--KIDRDDFLRKQRTFDNGSIPHQIIHLKEL | 421 |
| EFR44625 | 311 | --NGYAG | YIEG | K | VSQEDFYRYIKPILSR-L--KGGDEFLa--KIDRDDFLRKQRTFDNGSIPHQIIHLKEL | 373 |
| WP_002897477 | 357 | -DGYAG | YIDG | K | TTQEAFYKYIKNLLSK-F--EGADYFL--DKIEREDFLRKQRTFDNGSIPHQIIHLQEM | 419 |
| WP_002906454 | 357 | -DGYAG | YIDG | K | TTQEAFYKYIKNLLSK-L--EGADYFL--NKIEREDFLRKQRTFDNGSIPHQIIHLQEM | 419 |
| WP_009729476 | 358 | -DGYAG | FIDG | K | TTQETFYKYIKNLLSK-F--EGADYFL--DKIEREDFLRKQRTFDNGSIPHQIIHLQEM | 420 |
| CQR24647 | 358 | -NGYAG | YIDG | K | TNQEDFYKYLKNLLQK-V--DGGDYFI--EKIEREDFLRKQRTFDNGSIPHQVIHLDEM | 420 |
| WP_000066813 | 358 | -DGYAG | YIDG | K | TTQEAFYKYIKNLLSK-F--EGADYFL--DKIEREDFLRKQRTFDNGSIPHQIIHLQEM | 420 |
| WP_009754323 | 358 | -DGYAG | YIDG | K | TTQENFYRFIKKAIEK-I--EGSDYFI--DKIEREDFLRKQRTFDNGSIPHQIIHLQEM | 420 |
| WP_044674937 | 357 | -DGYAG | YIEG | K | TTQENFYRFIKKAIEK-I--EGSDYFI--DKIDREDFLRKQRTFDNGSIPHQIIHLQEM | 419 |
| WP_044676715 | 357 | -DGYAG | YIEG | K | TTQENFYRFIKKAIEK-I--EGSNYFI--DKIDREDFLRKQRTFDNGSIPHQIIHLQEM | 419 |
| WP_044680361 | 357 | -DGYAG | YIEG | K | TTQENFYRFIKKAIEK-I--EGSNYFI--DKIDREDFLRKQRTFDNGSIPHQIIHLQEM | 419 |
| WP_044681799 | 357 | -DGYAG | YIEG | K | TTQENFYRFIKKAIEK-I--EGSDYFI--DKIDREDFLRKQRTFDNGSIPHQIIHLQEM | 419 |
| WP_049533112 | 357 | --KGYAG | YIEG | G | VKQDEFYKYLKGILLQ-I--NGSGDFL--DKIDREDFLRKQRTFDNGSIPHQIIHLQEM | 419 |
| WP_029090905 | 316 | fyTDYIG | YEES | K | SKEERLFKHIELLAKeNv1TTVEHALLeKNITFASLLPLQRSSRNAVIPYQVHEKEL | 403 |
| WP_006506696 | 361 | ksKGYYN | YINR | G | APVDFYKYTVKKCIEK-VdtPEAKQILn--DIELENFLLKQNSRTNGSVPYQMQLDEM | 429 |
| AIT42264 | 357 | -NGYAG | YIDG | G | ASQEEFYKFIKPILEK-M--DGTEELLv--KLNREDLLRKQRTFDNGSIPHQIIHLGEL | 419 |
| WP_034440723 | 363 | -DGYAG | YIDG | K | TSQEDFYKFVKAQLKG---eENGEYFL--EAIENENFLRKQRSFYNGVIPYQIIHLQEL | 425 |
| AKQ21048 | 357 | -DGYAG | YIDG | G | ASQEEFYKFIKPILEK-M--DGTEELLv--KLNREDLLRKQRTFDNGSIPHQIIHLGEL | 419 |
| WP_004636532 | 356 | -NGYAG | YIDG | K | TNQEDFYKYIEKVMKT--IksDKKDYFL--DKIDREVFLRKQRSFYNSVIPHQIIHLQEM | 420 |
| WP_002364836 | 363 | -DGYAG | YIAH | A | VSQLKFYQVVKKIIQD-I--AGAEYFL--EKIAQENFLRKQRTFDNGVIPHQIIHLAEL | 427 |
| WP_002378009 | 363 | -DGYAG | YIAH | A | VSQLKFYQVVKKIIQD-I--AGAEYFL--EKIAQENFLRKQRTFDNGVIPHQIIHLAEL | 427 |
| WP_016631044 | 314 | -DGYAG | YITH | A | VSQLKFYQVVKKIIQD-I--AGAEYFL--EKVDQENFLLKQRTTANGVIPHQVHLTEL | 378 |
| EMS75795 | 100 | -NGYAG | YIDG | A | TTQEDFYKFKKELNG-I--AGSERFM--EKVDQENFLLKQRTTANGVIPHQVHLTEL | 162 |
| WP_002373311 | 363 | -DGYAG | YIAH | A | VSQLKFYQVVKKIIQD-I--AGAEYFL--EKIAQENFLRKQRTFDNGVIPHQIIHLAEL | 427 |
| WP_002413717 | 365 | -DGYAG | YIAH | A | VSQLKFYQVVKKIIQD-I--AGAEYFL--EKIAQENFLRKQRTFDNGVIPHQIIHLAEL | 429 |
| WP_010182869 | 363 | -DGYAG | YIAH | A | VSQLKFYQVVKKIIQD-I--AGAEYFL--EKIAQENFLRKQRTFDNGVIPHQIIHLAEL | 427 |
| WP_010822395 | 363 | -DGYAG | YITH | A | VSQLKFYQVVKKIIQD-I--AGAEYFL--EKIAQENFLRKQRTFDNGVIPHQIIHLAEL | 427 |
| WP_010622645 | 363 | -DGYAG | YIAH | A | VSQLKFYQVVKKIIQD-I--AGAEYFL--EKIAQENFLRKQRTFDNGVIPHQIIHLAEL | 427 |
| WP_033624816 | 363 | -DGYAG | YIAH | A | VSQLKFYQVVKKIIQD-I--AGAEYFL--EKIAQENFLRKQRTFDNGVIPHQIIHLAEL | 427 |
| WP_033625576 | 363 | -DGYAG | YIAH | A | VSQLKFYQVVKKIIQD-I--AGAEYFL--EKIAQENFLRKQRTFDNGVIPHQIIHLAEL | 427 |
| WP_033789179 | 361 | -DGYAG | YIEG | H | ATQEDFYKFVKKELTG-I--RGSEVFL--TKIEQENFLLKQRTYNGVIPHQVHLIEL | 423 |
| WP_002310644 | 362 | -NGYAG | YIEG | H | ATQEAFYKFVKKELTG-I--RGSEVFL--TKIEQENFLLKQRTYNGVIPHQVHLIEL | 424 |
| WP_002312694 | 362 | -NGYAG | YIKG | H | ATQEAFYKFVKKELTG-V--RGSEVFL--EKIDQETFLLKQRTYTNGVIPHQVHLIEL | 424 |
| WP_002314015 | 362 | -NGYAG | YIKG | H | ATQEDFYKFVKKELTG-V--VGSEPFL--EKIDQETFLLKQRTYTNGVIPHQVHLIEL | 424 |
| WP_002320716 | 362 | -NGYAG | YIEG | H | ATQEDFYKFVKKELTG-I--RGSEVFL--TKIEQENFLLKQRTYNGVIPHQVHLTEL | 424 |
| WP_002330729 | 361 | -NGYAG | YIEG | H | ATQEDFYKFVKKELTG-I--RGSEVFL--TKIEQENFLLKQRTFDNGVIPHQVHABEL | 423 |
| WP_002335161 | 362 | -NGYAG | YIEG | H | ATQEDFYKFVKKELTG-I--RGSEVFL--TKIEQENFLLKQRTFDNGVIPHQIIHLTEL | 424 |
| WP_002345439 | 362 | -NGYAG | YIEG | H | ATQEDFYKFVKKELTG-I--RGSEVFL--EKIDQETFLLKQRTFDNGVIPHQIIHLTEL | 424 |
| WP_034879970 | 355 | -NGYAG | YIKG | K | TTQEDFYKFVKKELSG-V--VGSEPPFL--VGSEPPFL--EKIDQETFLLKQRTFDNGETFLLKQRTFDNGVIPHQIIHLEEL | 417 |
| WP_047937432 | 362 | -DGYAG | YIEG | H | ATQEDFYKFKLRTLLAG-L--EESQSIM--EKIDEIYLLKQRTFANGVIPHQIHLVEM | 424 |
| WP_010720994 | 355 | -NGYAG | YIKG | K | TKEEEFYKYLKTTLVQ--kSGYQYFI--EKIDEIYLLKQRTFANGVIPHQIHLVEM | 417 |
| WP_010737004 | 355 | -NGYAG | YIKG | K | TTQEDFYKFLLKQRTFLDKQRTFDNGVIPHQVHAEEL | 417 |
| WP_034700478 | 359 | -NGYAG | YVKG | K | VTQABEFYKFLKKAIEK-V--PGAEYFL--EKIEQEFTFLDKQRTFDNGVIPHQIIHLEEL | 421 |
| WP_007029903 | 355 | -NGYAG | YVEN | S | TSQERKFYKYITNLIEK-I--DGAEYFL--KKIENEDFLRKQRTFDNGIIPHQIIHLEEL | 417 |
| WP_023519017 | 358 | -SGYAG | YIDN | K | TTQADFYKFLKKEPTG-V--PGSEPML--AKIDQENFLLKQRTPTNGVIPHQVHLTEF | 422 |
| WP_010770040 | 354 | -DGYAG | YIDG | K | ASQEEFYKFIKPILEK-M--DGTEELLv--KLNREDLLRKQRTFDNGSIPHQIIHLGEL | 418 |
| WP_048604708 | 355 | -DGYAG | YIDG | G | ASQEEFYKFIKPILEK-M--DGTEELLv--KLNREDLLRKQRTFDNGSIPHQIIHLGEL | 417 |
| WP_010750235 | 355 | -DGYAG | YIDG | G | ASQEEFYKFIKPILEK-M--DGTEELLv--KLNREDLLRKQRTFDNGSIPHQIIHLGEL | 417 |
| AII16583 | 396 | -DGYAG | YIDG | G | ASQEEFYKFIKPILEK-M--DGTEELLv--KLNREDLLRKQRTFDNGSIPHQIIHLGEL | 458 |

```
WP_029073316    367 kNNYCN    YINH  K TPVDEFYKYIKKLIEK-IdqPDVKTILn--KIELESFMLKQNSRTNGAVPYQMQLDEL 435
WP_031589969    367 kNNYCN    YINH  K TPVDEFYKYIKKLIEK-IdqPDVKTILn--KIELESFMLKQNSRTNGAVPYQMQLDEL 435
KDA45870        354 -iSGYAG   YIDG  K VSEEDFYKYKTKKTLKG-I-PETEEILq--KIDANNYLRKQRTFDNGAIPHQVHLKEL 417
WP_039099354    360 -------   YVDG  K --SKEDFYGDITKALKNnPIVSEIKk--LIELDQFMPKQRTFDNGAIPHQLHQQEL 425
AKP02966        349 -QAYDD    YINK  - ---KELYTSLKKFLKVaLp-TNLAKEAe-EKISKGTYLVKPRNSENGVVPYQLNKIEM 415
WP_010991369    363 -HGYAG    YIDG  - TKQADFYKYMKMTLEN-I-EGADYFI--AKIEKENFLRKQRTFDNGAIPHQLHEEL 425
WP_033838504    363 -HGYAG    YIDG  - TKQADFYKYMKMTLEN-I-EGADYFI--AKIEKENFLRKQRTFDNGAIPHQLHEEL 425
EHN60060        366 -HGYAG    YIDG  - TKQADFYKYMKMTLEN-I-EGADYFI--AKIEKENFLRKQRTFDNGAIPHQLHEEL 428
EFR89594        132 -HGYAG    YIDG  - TKQADFYKYMKMTLEN-I-DGADYFI--DQIEEENFLRKQRTFDNGTIPHQLHEEL 194
WP_038409211    363 -HGYAG    YIDG  - TTQEKFYKYMKKMLAN-I-DGADYFI--DQIEEENFLRKQRTFDNGTIPHQLHEEL 425
EFR95520          1 -------   ----  - ---MKKMLAN-I-EGSDYFI--AKIEEENFLRKQRTFDNGVIPHQLHEEL  44
WP_003723650    363 -DGYAG    YIDG  - TKQVDFYKYKLTTLEN-I-EGSDYFI--AKIEEENFLRKQRTFDNGVIPHQLHEEL 425
WP_003727705    363 -DGYAG    YIDG  - TKQVDFYKYKLTTLEN-V-EGADYFI--TKIEEENFLRKQRTFDNGVIPHQLHEEL 425
WP_003730785    363 -DGYAG    YIDG  - TKQVDFYKYKLTTLEN-V-EGADYFI--AKIEEENFLRKQRTFDNGVIPHQLHEEL 425
WP_003733029    363 -DGYAG    YIDG  - TKQADFYKYMKATLEK-I-EGADYFI--AKIEEENFLRKQRTFDNGVIPHQLHEEL 425
WP_003739838    363 -DGYAG    YIDG  - TKQVDFYKYKLTILEN-I-EGADYFI--AKIEEENFLRKQRTFDNGVIPHQLHEEL 425
WP_014601172    363 -DGYAG    YIDG  - TKQVDFYKYKLTILEN-V-EGSDYFI--TKIEEENFLRKQRTFDNGVIPHQLHEEL 425
WP_023548323    363 -DGYAG    YIDG  - TKQVDFYKYKLTILEN-I-EGSDYFI--AKIEEENFLRKQRTFDNGVIPHQLHEEL 425
WP_031666337    363 -HGYAG    YISG  - TKQVDFYKYKLTILEN-I-EGADYFI--AKIEEENFLRKQRTFDNGVIPHQLHEEL 425
WP_031669209    363 -DGYAG    YIDG  - TKQVDFYKYKLTILEN-I-EGADYFI--AKIEEENFLRKQRTFDNGVIPHQLHEEL 425
WP_033920898    363 -DGYAG    YIDG  - TKQVDFYKYKLTILEN-I-EGADYFI--AKIEEENFLRKQRTFDNGVIPHQLHEEL 425
AKI42028        366 -DGYAG    YIDG  - TKQVDFYKYKLTILEN-I-EGADYFI--AKIEEENFLRKQRTFDNGVIPHQLHEEL 428
AKI50529        366 -DGYAG    YIDG  - -------MLEH-V-EGADYFI--NQIEEENFLRKQRTFDNGVIPHQLHEEL 428
EFR83390          1 -------   ----  - ------- ---                                               
WP_046323366    363 -DGYAG    YIEG  G TKQEAFYKYMKKMLEH-V-EGADYFI--NQIEEENFLRKQRTFDNGVIPHQLHEEL 425
AKE81011        373 -NGYAG    YIDG  G ASQEBFYKFKPILEK-M-DGTEELLv--KLNREDLLRKQRTFDNGSIPHQIHLGEL 435
CUO82355        365 kvKGYYN   YINR  K APVDEFYKFVKKCIEK-VdtPEAKQILh--DIELENFMLKQNSRTNGSVPYQMQLDEM 433
WP_033162887    366 kLHNYLG   YIKY  D TPVEEFYKYIKGLLAK-VdtDEAREILe--RIDLEKFMLKQNSRTNGSIPYQMQKDEM 434
AGZ01981        390 -NGYAG    YIDG  G ASQEBFYKFKPILEK-M-DGTEELLv--KLNREDLLRKQRTFDNGSIPHQIHLGEL 452
AKA60242        357 -NGYAG    YIDG  G ASQEBFYKFKPILEK-M-DGTEELLv--KLNREDLLRKQRTFDNGSIPHQIHLGEL 419
AKS40380        357 -NGYAG    YIDG  G ASQEBFYKFKPILEK-M-DGTEELLv--KLNREDLLRKQRTFDNGSIPHQIHLGEL 419
4UN5_B          361 -NGYAG    YIDG  G ASQEBFYKFKPILEK-M-DGTEELLv--KLNREDLLRKQRTFDNGSIPHQIHLGEL 423

WP_010922251    420 HAILRRQEDFYPFLKD--NRE KIEKILTFRIPYYVGPL        ARG-n-SRFAWMTR--KSEETITPWNFEEVVDKGA 486

WP_039695303    423 HAILRRQEDFYPFLKD--NRE RIEKILTFRIPYYVGPL        VRKD-SRFAWABY--RSDEKITPWNFDKVIDKEK 489
WP_045635197    420 NAILRRQEGEYYPPLKD--NKE KIEKILTFRIPYYVGPL        ARGN-RDFAWLTR--NSDEAIRPWNFEEIVDKAS 486
5AXW_A          184 KQLLKVQKAYHQLDQSfi--D TYIDLLETRRTYYEGPG         ---Eg-SPFGWKDI-----------------  229
WP_009880683    104 HAILRRQEDFYPFLKD--NRE KIEKILTFRIPYYVGPL        ARG-n-SRFAWMTR--KSEETITPWNFEEVVDKGA 170
WP_010922251    420 HAILRRQEDFYPFLKD--NRE KIEKILTFRIPYYVGPL        ARG-n-SRFAWMTR--KSEETITPWNFEEVVDKGA 486
WP_011054416    420 HAILRRQEDFYPFLKD--NRE KIEKILTFRIPYYVGPL        ARG-n-SRFAWMTR--KSEETITPWNFEEVVDKGA 486
WP_011284745    420 HAILRRQEDFYPFLKD--NRE KIEKILTFRIPYYVGPL        ARG-n-SRFAWMTR--KSEETITPWNFEEVVDKGA 486
WP_011285506    420 HAILRRQEDFYPFLKD--NRE KIEKILTFRIPYYVGPL        ARG-n-SRFAWMTR--KSEETITPWNFEEVVDKGA 486
WP_011527619    420 HAILRRQEDFYPFLKD--NRE KIEKILTFRIPYYVGPL        ARG-n-SRFAWMTR--KSEETITPWNFEEVVDKGA 486
WP_012560673    420 HAILRRQEDFYPFLKD--NRE KIEKILTFRIPYYVGPL        ARG-n-SRFAWMTR--KSEETITPWNFEEVVDKGA 486
WP_014407541    420 HAILRRQEDFYPFLKD--NRE KIEKILTFRIPYYVGPL        ARG-n-SRFAWMTR--KSEETITPWNFEEVVDKGA 486
WP_020905136    420 HAILRRQEDFYPFLKD--NRE KIEKILTFRIPYYVGPL        ARG-n-SRFAWMTR--KSEETITPWNFEEVVDKGA 486
WP_023080005    420 HAILRRQEDFYPFLKD--NRE KIEKILTFRIPYYVGPL        ARG-n-SRFAWMTR--KSEETITPWNFEEVVDKGA 486
WP_023610282    420 HAILRRQEDFYPFLKD--NRE KIEKILTFRIPYYVGPL        ARG-n-SRFAWMTR--KSEETITPWNFEEVVDKGA 486
WP_030125963    420 HAILRRQEDFYPFLKD--NRE KIEKILTFRIPYYVGPL        ARG-n-SRFAWMTR--KSEETITPWNFEEVVDKGA 486
WP_030126706    420 HAILRRQEDFYPFLKD--NRE KIEKILTFRIPYYVGPL        ARG-n-SRFAWMTR--KSEETITPWNFEEVVDKGA 486
WP_031488318    420 HAILRRQEDFYPFLKD--NRE KIEKILTFRIPYYVGPL        ARG-n-SRFAWMTR--KSEETITPWNFEEVVDKGA 486
```

| | | | | | |
|---|---|---|---|---|---|
| WP_032460140 | 420 | HAILRRQEDFYPPLKD--NRE | KIEKILTFRIPYYVGPL | ARG-n-SRFAWMTR---KSEETITPWNFEEVVDKGA | 486 |
| WP_032461047 | 420 | HAILRRQEDFYPPLKD--NRE | KIEKILTFRIPYYVGPL | ARG-n-SRFAWMTR---KSEETITPWNFEEVVDKGA | 486 |
| WP_032462016 | 420 | HAILRRQEDFYPPLKD--NRE | KIEKILTFRIPYYVGPL | ARG-n-SRFAWMTR---KSEETITPWNFEEVVDKGA | 486 |
| WP_032462936 | 420 | HAILRRQEDFYPPLKD--NRE | KIEKILTFRIPYYVGPL | ARG-n-SRFAWMTR---KSEETITPWNFEEVVDKGA | 486 |
| WP_032464890 | 420 | HAILRRQEDFYPPLKD--NRE | KIEKILTFRIPYYVGPL | ARG-n-SRFAWMTR---KSEETITPWNFEEVVDKGA | 486 |
| WP_033888930 | 245 | HAILRRQEDFYPPLKD--NRE | KIEKILTFRIPYYVGPL | ARG-n-SRFAWMTR---KSEETITPWNFEEVVDKGA | 311 |
| WP_038431314 | 420 | HAILRRQEDFYPPLKD--NRE | KIEKILTFRIPYYVGPL | ARG-n-SRFAWMTR---KSEETITPWNFEEVVDKGA | 486 |
| WP_038432938 | 420 | HAILRRQEDFYPPLKD--NRE | KIEKILTFRIPYYVGPL | ARG-n-SRFAWMTR---KSEETITPWNFEEVVDKGA | 486 |
| WP_038434062 | 420 | HAILRRQEDFYPPLKD--NRE | KIEKILTFRIPYYVGPL | ARG-n-SRFAWMTR---KSEETITPWNFEEVVDKGA | 486 |
| BAQ51233 | 331 | HAILRRQEDFYPPLKD--NRE | KIEKILTFRIPYYVGPL | ARG-n-SRFAWMTR---KSEETITPWNFEEVVDKGA | 397 |
| KGE60856 | | ------------------ | ----------------- | ----------------------------------- | |
| KGE60162 | | ------------------ | ----------------- | ----------------------------------- | |
| WP_002989955 | 420 | HAILRRQEDFYPPLKD--NRE | KIEKILTFRIPYYVGPL | ARG-n-SRFAWMTR---KADEKITPWNFDDILDKEK | 486 |
| WP_003030002 | 420 | HAILRRQEHYPPLKE--NQD | KIEKILTFRIPYYVGPL | ARKG--SRFAWAEY---HSDEKITPWNFDKVIDKEK | 486 |
| WP_003065552 | 423 | HAILRRQGDYYPPLKE--NLD | KIEKILTFRIPYYVGPL | ARKD--SRFSWAEY---KTDDSIRPWNFEDLVDKEK | 489 |
| WP_001040076 | 421 | RAIIRRQSEYYPPLKE--NLD | RIEKILTFRIPYYIGPL | AREK--SDFAWMTR---KTDDSIRPWNFEDLVDKEK | 487 |
| WP_001040078 | 421 | KAIIRRQSEYYPPLKE--NQD | RIEKILTFRIPYYIGPL | AREK--SDFAWMTR---KTDDSIRPWNFEDLVDKEK | 487 |
| WP_001040080 | 421 | KAIIRRQSEYYPPLKE--NQD | RIEKILTFRIPYYVGPL | AREK--SDFAWMTR---KTDDSIRPWNFEDLVDKEK | 487 |
| WP_001040081 | 421 | KAIIRRQSEYYPPLKE--NQD | RIEKILTFRIPYYVGPL | AREK--SDFAWMTR---KTDDSIRPWNFEDLVDKEK | 487 |
| WP_001040083 | 421 | KAIIRRQSEYYPPLKE--NQD | RIEKILTFRIPYYVGPL | AREK--SDFAWMTR---KTDDSIRPWNFEDLVDKEK | 487 |
| WP_001040085 | 421 | KAIIRRQSEYYPPLKE--NQD | RIEKILTFRIPYYIGPL | AREK--SDFAWMTR---KTDDSIRPWNFEDLVDKEK | 487 |
| WP_001040087 | 421 | KAIIRRQSEYYPPLKE--NQD | RIEKILTFRIPYYIGPL | AREK--SDFAWMTR---KTDDSIRPWNFEDLVDKEK | 487 |
| WP_001040088 | 421 | KAIIRRQSEYYPPLKE--NQD | RIEKILTFRIPYYIGPL | AREK--SDFAWMTR---KTDDSIRPWNFEDLVDKEK | 487 |
| WP_001040089 | 421 | KAIIRRQSEYYPPLKE--NLD | RIEKILTFRIPYYIGPL | AREK--SDFAWMTR---KTDDSIRPWNFEDLVDKEA | 487 |
| WP_001040090 | 421 | KAIIRRQSEYYPPLKE--NQD | RIEKILTFRIPYYVGPL | AREK--SDFAWMTR---KTDDSIRPWNFEDLVDKEK | 487 |
| WP_001040091 | 421 | KAIIRRQSEYYPPLKE--NQD | RIEKILTFRIPYYIGPL | ARGN--SDFAWMTR---KTDDSIRPWNFEDLVDKEK | 487 |
| WP_001040092 | 421 | KAIIRRQSEYYPPLKE--NQD | RIEKILTFRIPYYIGPL | AREK--SDFAWMTR---KTDDSIRPWNFEELVDKEK | 487 |
| WP_001040094 | 421 | RAIIRRQSEYYPPLKE--NLD | RIEKILTFRIPYYIGPL | AREK--SDFAWMTR---KTDDSIRPWNFEDLVDKEK | 487 |
| WP_001040095 | 421 | RAIIRRQSEYYPPLKE--NLD | RIEKILTFRIPYYIGPL | AREK--SDFAWMTR---KTDDSIRPWNFEDLVDKEK | 487 |
| WP_001040096 | 421 | RAIIRRQSEYYPPLKE--NLD | RIEKILTFRIPYYIGPL | AREK--SDFAWMTR---KTDDSIRPWNFEDLVDKEK | 487 |
| WP_001040097 | 421 | RAIIRRQSEYYPPLKE--NLD | RIEKILTFRIPYYVGPL | AREK--SDFAWMTR---KTDDSIRPWNFEELVDKEK | 487 |
| WP_001040098 | 421 | RAIIRRQSEYYPPLLKE--NLD | RIEKILTFRIPYYVGPL | AREK--SDFAWMTR---KTDDSIRPWNFEELVDKEK | 487 |
| WP_001040099 | 421 | KAIIRRQSEYYPPLKE--NQD | KIEKILTFRIPYYVGPL | ARGN--SDFAWMTR---KTDDSIRPWNFEDLVDKEK | 487 |
| WP_001040100 | 421 | RAIIRRQSEYYPPLKE--NLD | RIEKILTFRIPYYIGPL | AREK--SDFAWMTR---KTDDSIRPWNFEDLVDKEK | 487 |
| WP_001040104 | 421 | KAIIRRQSEYYPPLKE--NQD | RIEKILTFRIPYYIGPL | AREK--SDFAWMTR---KTDDSIRPWNFEDLVDKEK | 487 |
| WP_001040105 | 421 | KAIIRRQSEYYPPLKE--NLD | RIEKILTFRIPYYIGPL | AREK--SDFAWMTR---KTDDSIRPWNFEDLVDKEK | 487 |
| WP_001040106 | 421 | KAIIRRQSEYYPPLKE--NLD | RIEKILTFRIPYYIGPL | AREK--SDFAWMTR---KTDDSIRPWNFEELVDKEA | 487 |
| WP_001040107 | 421 | KAIIRRQSEYYPPLKE--NQD | RIEKILTFRIPYYIGPL | AREK--SDFAWMTR---KTDDSIRPWNFEDLVDKEK | 487 |
| WP_001040108 | 421 | KAIIRRQSEYYPPLKE--NLD | RIEKILTFRIPYYIGPL | AREK--SDFAWMTR---KTDDSIRPWNFEELVDKEA | 487 |
| WP_001040109 | 421 | KAIIRRQSEYYPPLKE--NQD | RIEKILTFRIPYYIGPL | AREK--SDFAWMTR---KTDDSIRPWNFEDLVDKEK | 487 |
| WP_001040110 | 421 | KAIIRRQSEYYPPLKE--NLD | RIEKILTFRIPYYIGPL | AREK--SDFAWMTR---KTDDSIRPWNFEELVDKEA | 487 |
| WP_015058523 | 421 | KAIIRRQSEYYPPLKE--NLD | KIEKILTFRIPYYIGPL | ARGN--SDFAWMTR---KTDDSIRPWNFEELVDKEK | 487 |
| WP_017643650 | 421 | RAIIRRQSEYYPPLKE--NLD | RIEKILTFRIPYYIGPL | AREK--SDFAWMTR---KTDDSIRPWNFEDLVDKEK | 487 |
| WP_017647151 | 421 | KAIIRRQSEYYPPLKE--NLD | RIEKILTFRIPYYIGPL | AREK--SDFAWMTR---KTDDSIRPWNFEELVDKEA | 487 |
| WP_017649527 | 421 | KAIIRRQSEYYPPLKE--NLD | RIEKILTFRIPYYIGPL | AREK--SDFAWMTR---KTDDSIRPWNFEELVDKEA | 487 |
| WP_017771611 | 421 | KAIIRRQSEYYPPLKE--NLD | RIEKILTFRIPYYIGPL | AREK--SDFAWMTR---KTDDSIRPWNFEELVDKEA | 487 |
| WP_017771984 | 421 | KAIIRRQSEYYPPLKE--NQD | RIEKILTFRIPYYIGPL | AREK--SDFAWMTR---KTDDSIRPWNFEDLVDKEK | 487 |
| CFQ25032 | 421 | KAIIRRQSEYYPPLKE--NQD | RIEKILTFRIPYYIGPL | AREK--SDFAWMTR---KTDDSIRPWNFEDLVDKEK | 487 |
| CFV16040 | 421 | KAIIRRQSEYYPPLKE--NQD | RIEKILTFRIPYYIGPL | AREK--SDFAWMTR---KTDDSIRPWNFEDLVDKEK | 487 |
| KLJ37842 | 421 | KAIIRRQSEYYPPLKE--NQD | RIEKILTFRIPYYIGPL | AREK--SDFAWMTR---KTDDSIRPWNFEDLVDKEK | 487 |
| KLJ72361 | 421 | KAIIRRQSEYYPPLKE--NQD | RIEKILTFRIPYYIGPL | AREK--SDFAWMTR---KTDDSIRPWNFEDLVDKEK | 487 |
| KLL20707 | 421 | KAIIRRQSEYYPPLKE--NQD | RIEKILTFRIPYYIGPL | AREK--SDFAWMTR---KTDDSIRPWNFEDLVDKEK | 487 |

-continued

| | | | | | |
|---|---|---|---|---|---|
| KLL42645 | 421 | KAIIRRQSEYYPPLKE--NLD | RIEKILTFRIPYYVGPL | AREK-SDFAWMTR---KTDDSIRPWNFEELVDKEA | 487 |
| WP_047207273 | 421 | KAIIRRQSEYYPPLKE--NQD | RIEKILTFRIPYYIGPL | AREK-SDFAWMTR---KTDDSIRPWNFEDLVDKEK | 487 |
| WP_047209694 | 421 | RAIIRRQSEYYPPLKE--NLD | RIEKILTFRIPYYIGPL | AREK-SDFAWMTR---KTDDSIRPWNFEDLVDKEK | 487 |
| WP_050198062 | 421 | KAIIRRQSEYYPPLKE--NQD | RIEKILTFRIPYYIGPL | AREK-SDFAWMTR---KTDDSIRPWNFEDLVDKEK | 487 |
| WP_050201642 | 421 | KAIIRRQSEYYPPLKE--NQD | RIEKILTFRIPYYIGPL | AREK-SDFAWMTR---KTDDSIRPWNFEELVDKEK | 487 |
| WP_050204027 | 421 | KAIIRRQSEYYPPLKE--NLD | RIEKILTFRIPYYIGPL | AREK-SDFAWMTR---KTDDSIRPWNFEDLVDKEK | 487 |
| WP_050881965 | 421 | KAIIRRQSEYYPPLKE--NQD | RIEKILTFRIPYYIGPL | AREK-SDFAWMTR---KTDDSIRPWNFEDLVDKEK | 487 |
| WP_050886065 | 421 | KDIIRRQSEYYPPLKE--NQD | RIEKILTFRIPYYIGPL | AREK-SDFAWMTR---KTDDSIRPWNFEDLVDKEK | 487 |
| AHN30376 | 421 | KAIIRRQSEYYPPLKE--NQD | RIEKILTFRIPYYIGPL | ARGN-SDFAWMTR---KTDDSIRPWNFEDLVDKEK | 487 |
| EA078426 | 421 | KAIIRRQSEYYPPLKE--NQD | RIEKILTFRIPYYIGPL | AREK-SDFAWMTR---KTDDSIRPWNFEDLVDKEK | 487 |
| CCW42055 | 421 | RAIIRRQSEYYPPLKE--NLD | RIEKILTFRIPYYIGPL | AREK-SDFAWMTR---KTDDSIRPWNFEELVDKEK | 487 |
| WP_003041502 | 420 | HAILRRQGEHYPPLKE--NQD | KIEKILTFRIPYYVGPL | ARKG-SRFAWAEY---KADEKITPWNFDDILDKEK | 486 |
| WP_037593752 | 420 | HAILRRQGEHYPPLKE--NQD | KIEKILTFRIPYYVGPL | ARKG-SRFAWAEY---KADEKITPWNFDDILDKEK | 486 |
| WP_049516684 | 421 | HAILRRQGEHYPPLKE--NRE | KIEKILTFRIPYYVGPL | ARKG-SRFAWAEY---KADEKITPWNFDDILDKEK | 487 |
| GAD46167 | 421 | HAILRRQGEHYPPLKE--NQD | KIEKILTFRIPYYVGPL | ARKD-SRFAWAEY---KADEKITPWNFEEVVDKGA | 487 |
| WP_018363470 | 430 | HAILRRQEFYPPLKE--NQE | EIEKILTFRIPYYVGPL | ARG-n-SRFAWLTR---KSEEAITPWNFEEVVDKGA | 496 |
| WP_003043819 | 420 | HAILRRQGEHYPPLKE--NRE | KIEKILTFRIPYYVGPL | ARKG-SRFAWAEY---KADEKITPWNFDDILDKEK | 486 |
| WP_006269658 | 420 | HAILRRQEFYPPLKE--NQD | KIEKILTFRIPYYVGPL | VRKG-SRFAWAEY---KADEKITPWNFDDILDKEK | 486 |
| WP_048800889 | 420 | HAILRRQEDFYPPLKD--NRE | KIEKILTFRIPYYVGPL | ARG-n-SRFAWMTR---KSEETITPWNFEEVVDKGA | 486 |
| WP_012767106 | 420 | HAILRRQEDFYPPLKD--NRE | KIEKILTFRIPYYVGPL | ARG-n-SRFAWMTR---KSEETITPWNFEEVVDKGA | 486 |
| WP_014612333 | 420 | HAILRRQEDFYPPLKD--NRE | KIEKILTFRIPYYVGPL | ARG-n-SRFAWMTR---KSEETITPWNFEEVVDKGA | 486 |
| WP_015017095 | 420 | HAILRRQEDFYPPLKD--NRE | KIEKILTFRIPYYVGPL | ARG-n-SRFAWMTR---KSEETITPWNFEEVVDKGA | 486 |
| WP_015057649 | 420 | HAILRRQEDFYPPLKD--NRE | KIEKILTFRIPYYVGPL | ARG-n-SRFAWMTR---KSEETITPWNFEEVVDKGA | 486 |
| WP_048327215 | 420 | HAILRRQEDFYPPLKD--NRE | KIEKILTFRIPYYVGPL | ARG-n-SRFAWMTR---KSEETITPWNFEEVVDKGA | 486 |
| WP_049519324 | 420 | HAILRRQEDFYPPLKD--NRE | KIESLLTFRIPYYVGPL | ARG-n-SRFAWVKR---KFDGAIRPWNFEEIVDEEA | 486 |
| WP_012515931 | 420 | HAILRRQEVEYPPLKE--NRK | KIESLLTFRIPYYVGPL | ARG-h-SRFAWVKR---KFDGAIRPWNFEEIVDEEA | 486 |
| WP_021320964 | 420 | HAILRRQEVEYPPLKE--NRK | KIESLLTFRIPYYVGPL | ARG-h-SRFAWVKR---KFDGAIRPWNFEEIVDEEA | 486 |
| WP_037581760 | 420 | HAILRRQEVEYPPLKE--NRK | KIEKILTFRIPYYVGPL | ARG-h-SRFAWAEY---KADEKITPWNFEEVVDKEK | 486 |
| WP_004232481 | 421 | RTILRRQGEYYPPLKE--NQA | RIEKILTFRIPYYVGPL | ARKN-SRFAWAKY---HSDEPITPWNFEVVDKEK | 487 |
| WP_009854540 | 421 | HAILRRQGDYYPPLKE--KQD | RIEKILTFRIPYYVGPL | VRKD-SRFAWAEY---RSDEKITPWNFDKVLDKEK | 487 |
| WP_012962174 | 421 | HAILRRQGEHYAFLKE--NQD | RIEKILTFRIPYYVGPL | VRKD-SRFAWAEY---HSDEKITPWNFDEIVDKEK | 487 |
| WP_039695303 | 423 | HAILRRQGDYYPPLKE--KQD | RIEKILTFRIPYYVGPL | VRKD-SRFAWANY---RSDEKITPWNFDEVVDKEK | 489 |
| WP_014334983 | 420 | HSILRRQGDYYPPLKE--NQA | RIEKILTFRIPYYVGPL | ARKD-SRFAWANY---HSDEPITPWNFDEVVDKEK | 486 |
| WP_003099269 | 420 | KAIIRRQEKEYPPLKE--NQK | KIEKILFTFKIPYYVGPL | ANG-q-SSFAWLKR---QSNESITPWNFEEVVDQEA | 486 |
| AHY15608 | | ----------------- | ---------------- | ANG-q-SSFAWLKR---QSNESITPWNFEEVVDQEA | 486 |
| AHY17476 | 420 | KAIIRRQEKEYPPLKE--NQK | KIEKILFTFKIPYYVGPL | ANG-q-SSFAWLKR---QSNESITPWNFEEVVDQEA | 486 |
| ESR09100 | | | | | |
| AGM98575 | 420 | KAIIRRQEKEYPPLKE--NQK | KIEKILFTFKIPYYVGPL | ARGK-SDFSWLSR---KSADKITPWNFDEIVDKES | 486 |
| ALF27331 | 420 | KAIIRRQAEFYPPLAD--NQD | RIEKILTFRIPYYVGPL | ARGN-SDFAWLQR---KSDEAIRPWNFEQVVDMET | 486 |
| WP_018372492 | 433 | QAIILNQSKYYPPLAE--NKE | RIEKILTFRIPYYVGPL | ARGN-RDFAWLTR---NSDQAIRPWNFEEIVDKAR | 499 |
| WP_045618028 | 420 | NAIIRRQGEYYPPLKD--NKE | RIEKILTFRIPYYVGPL | ARGN-RDFAWLTR---NSDEAIRPWNFEEIVDKAS | 487 |
| WP_045635197 | 420 | RAIIRRQGEYYPPLAD--NQD | RIEKILTFRIPYYVGPL | ARGK-SDFAWLSR---KSADKITPWNFDEIVDKES | 486 |
| WP_002263549 | 420 | RAIIRRQAEFYPPLAD--NQD | RIEKILTFRIPYYVGPL | ARGK-SDFAWLSR---KSADKITPWNFDEIVDKES | 486 |
| WP_002263887 | 420 | RAIIRRQAEFYPPLAD--NQD | RIEKILTFRIPYYVGPL | ARGK-SDFAWLSR---KSADKITPWNFDEIVDKES | 486 |
| WP_002264920 | 420 | HAILRRQAEFYPPLAD--NQD | RIEKILTFRIPYYVGPL | ARGK-SDFAWLSR---KSADKITPWNFDEIVDKES | 486 |
| WP_002269043 | 420 | RAIIRRQAEFYPPLAD--NQD | RIEKILTFRIPYYVGPL | ARGK-SDFAWLSR---KSADKITPWNFDEIVDKES | 486 |
| WP_002269448 | 420 | RAIIRRQAEFYPPLAD--NQD | RIEKILTFRIPYYVGPL | ARGK-SDFAWLSR---KSADKITPWNFDEIVDKES | 486 |
| WP_002271977 | 420 | RAIIRRQAEFYPPLAD--NQD | RIEKILTFRIPYYVGPL | ARGK-SDFAWLSR---KSADKITPWNFDEIVDKES | 486 |
| WP_002272766 | 420 | RAIIRRQAEFYPPLAD--NQD | RIEKILTFRIPYYVGPL | ARGK-SDFAWLSR---KSADKITPWNFDEIVDKES | 486 |
| WP_002273241 | 420 | RAIIRRQAEFYPPLAD--NQD | RIEKILTFRIPYYVGPL | ARGK-SDFAWLSR---KSADKITPWNFDEIVDKES | 486 |
| WP_002275430 | 420 | RAIIRRQAEFYPPLAD--NQD | RIEKILTFRIPYYVGPL | ARGK-SDFAWLSR---KSADKITPWNFDEIVDKES | 486 |
| WP_002276448 | 420 | RAIIRRQAEFYPPLAD--NQD | RIEKILTFRIPYYVGPL | ARGK-SDFAWLSR---KSADKITPWNFDEIVDKES | 486 |
| WP_002277050 | 420 | HAILRRQGDYYPPLKE--NQD | RIEKILTFRIPYYVGPL | ARKN-SRFAWAEY---HSDEAVMPWNFDQVIDKES | 486 |

```
-continued

WP_002773364   420 RAIIRRQAEFYPFLAD--NQD RIEKILTFRIPYYVGPL ARGK--SDFAWLSR---KSADKITPWNFDEIVDKES 486
WP_002279025   420 RAIIRRQSEFYPFLAD--NQD RIEKILTFRIPYYVGPL ARGK--SDFAWLSR---KSADKITPWNFDEIVDKES 486
WP_002279859   420 RAIIRRQAEFYPFLAD--NQD RIEKILTFRIPYYVGPL ARGK--SDFAWLSR---KSADKITPWNFDEIVDKES 486
WP_002280230   420 RAIIRRQAEFYPFLAD--NQD RIEKILTFRIPYYVGPL ARGK--SDFAWLSR---KSADKITPWNFDEIVDKES 486
WP_002281696   420 RAIIRRQAEFYPFLAD--NQD RIEKILTFRIPYYVGPL ARGK--SDFAWAEY---HSDEAVTPWNFDEIVDKES 486
WP_002282247   420 HAILRRQGDYYPFLKE--NQD RIEKILTFRIPYYVGPL ARKN--SRFAWAEY---HSDEAVTPWNFDQVIDKES 486
WP_002282906   420 RAIIRRQAEFYPFLAD--NQD RIEKILTFRIPYYVGPL ARGK--SDFAWLSR---KSADKITPWNFDEIVDKES 486
WP_002283846   420 RAIIRRQAEFYPFLAD--NQD RIEKILTFRIPYYVGPL ARGK--SDFAWLSR---KSADKITPWNFDEIVDKES 486
WP_002287255   420 RAIIRRQAEFYPFLAD--NQD RIEKILTFRIPYYVGPL ARGK--SDFAWLSR---KSADKITPWNFDEIVDKES 486
WP_002288990   420 RAIIRRQAEFYPFLAD--NQD RIEKILTFRIPYYVGPL ARGK--SDFAWLSR---KSADKITPWNFDEIVDKES 486
WP_002289641   420 RAIIRRQAEFYPFLAD--NQD RIEKILTFRIPYYVGPL ASGK--SDFAWLSR---KSADKITPWNFDEIVDKES 486
WP_002290427   420 RAIIRRQAEFYPFLAD--NQD RIEKILTFRIPYYVGPL ARGK--SDFAWLSR---KSADKITPWNFDEIVDKES 486
WP_002295753   420 RAIIRRQAEFYPFLAD--NQD RIEKILTFRIPYYVGPL ARGK--SDFAWLSR---KSADKITPWNFDEIVDKES 486
WP_002296423   420 HAILRRQGEHYPFLKE--NQD RIEKILTFRIPYYVGPL ARGK--SDFAWAEY---KADEKITPWNFDDILDKEK 496
WP_002304487   430 RAIIRRQAEFYPFLAD--NQD KIEKILTFRIPYYVGPL VRKG--SRFAWAEY---KADEKITPWNFDDILDKEK 496
WP_002305844   420 RAIIRRQAEFYPFLAD--NQD RIEKILTFRIPYYVGPL ARGK--SDFAWLSR---KSADKITPWNFDEIVDKES 486
WP_002307203   420 RAIIRRQAEFYPFLAD--NQD RIEKILTFRIPYYVGPL ARGK--SDFAWLSR---KSADKITPWNFDEIVDKES 486
WP_002310390   420 RAIIRRQAEFYPFLAD--NQD RIEKILTFRIPYYVGPL ARGK--SDFAWLSR---KSADKITPWNFDEIVDKES 486
WP_002352408   420 RAIIRRQAEFYPFLAD--NQD RIEKILTFRIPYYVGPL ARGK--SDFAWLSR---KSADKITPWNFDEIVDKES 486
WP_012997688   420 RAIIRRQAEFYPFLAD--NQD RIEKILTFRIPYYVGPL ARGK--SDFAWLSR---KSADKITPWNFDEIVDKES 486
WP_014677909   420 RAIIRRQAEFYPFLAD--NQD RIEKILTFRIPYYVGPL ARGK--SDFAWLSR---KSADKITPWNFDEIVDKES 486
WP_019312892   420 RAIIRRQAEFYPFLAD--NQD RIEKILTFRIPYYVGPL ARGK--SDFAWLSR---KSADKITPWNFDEIVDKES 486
WP_019313659   420 RAIIRRQAEFYPFLAD--NQD RIEKILTFRIPYYVGPL ARGK--SDFAWLSR---KSADKITPWNFDEIVDKES 486
WP_019314093   420 RAIIRRQAEFYPFLAD--NQD RIEKILTFRIPYYVGPL ARGK--SDFAWLSR---KSADKITPWNFDEIVDKES 486
WP_019315370   420 RAIIRRQAEFYPFLAD--NQD RIEKILTFRIPYYVGPL ARGK--SDFAWLSR---KSADKITPWNFDEIVDKES 486
WP_019803776   420 RAIIRRQAEFYPFLAD--NQD RIEKILTFRIPYYVGPL ARGK--SDFAWLSR---KSADKITPWNFDEIVDKES 486
WP_019805234   420 RAIIRRQAEFYPFLAD--NQD RIEKILTFRIPYYVGPL ARGK--SDFAWLSR---KSADKITPWNFDEIVDKES 486
WP_024783594   420 RAIIRRQAEFYPFLAD--NQD RIEKILTFRIPYYVGPL ARGK--SDFAWLSR---KSADKITPWNFDEIVDKES 486
WP_024784288   420 HAILRRQGDYYPFLKE--NQD RIEKILTFRIPYYVGPL ARKN--SRFAWAEY---HSDEAVTPWNFDQVIDKES 486
WP_024784666   420 RAIIRRQAEFYPFLAD--NQD RIEKILTFRIPYYVGPL ARGK--SDFAWLSR---KSADKITPWNFDEIVDKES 486
WP_024784894   420 HAILRRQGDYYPFLKE--NQD RIEKILTFRIPYYVGPL ASGK--SDFAWLSR---KSADKITPWNFDEIVDKES 486
WP_024786433   420 RAIIRRQAEFYPFLAD--NQD RIEKILTFRIPYYVGPL ARKN--SRFAWAEY---HSDEAVTPWNFDQVIDKES 486
WP_024786631   420 RAIIRRQAEFYPFLAD--NQD RIEKILTFRIPYYVGPL ARGK--SDFAWLSR---KSADKITPWNFDEIVDKES 486
WP_049473442   420 RAIIRRQAEFYPFLAD--NQD RIEKILTFRIPYYVGPL ASGK--SDFAWLSR---KSADKITPWNFDEIVDKES 486
WP_049474547   420 RAIIRRQAEFYPFLAD--NQD RIEKILTFRIPYYVGPL ARGK--SDFAWLSR---KSADKITPWNFDEIVDKES 486
EMC03581       413 RAIIRRQAEFYPFLAD--NQD KIEKILTFRIPYYVGPL ARGN--RDFAWLTR---NSDQAIRPWNFEEIVDKAS 479
WP_000428612   421 NAILRRQGEHYPFLKE--NKE KIEKILTFRIPYYVGPL ARGN--RDFAWLTR---NSDEAIRPWNFEEIVDKAS 487
WP_000428613   421 NAILRRQGEHYPFLKD--NKE KIEKILTFRIPYYVGPL ARGN--RDFAWLTR---NSDEAIRPWNFEEIVDKAS 487
WP_049523028   420 NAILRHQGEHYPFLKE--NKD KIEQLTFRIPYYVGPL ARGN--SDFAWLSR---NSDEAIRPWNFEEMVDKSS 486
WP_003107102   389 KSIIRRQBKYYPFLKD--KQV RIEKFTFRIPYYVGPL ANG--n-SSFAWVKR---RSNESITPWNFEEVVEQEA 455
WP_054279288   422 QAILERQGQAYYPFLKD--NQE RIEKILTFRIPYYIGPL ARG--n-SRFAWLTR---TSDQKITPWNFDEMVDQEA 488
WP_049531101   421 NAILRRQGEHYPFLKE--NRE KIEKILTFRIPYYVGPL ARGN--RDFAWLTR---NSDQAIRPWNFEEIVDKAS 487
WP_049538452   421 NAILRRQGEHYPFLKE--NKE KIEKILTFRIPYYVGPL ARGN--RDFAWLTR---NSDQAIRPWNFEEIVDKAS 487
WP_049549711   421 NAILRRQGEHYPFLKE--NKE KIEKILTFRIPYYVGPL AKGGn--SSFAWLKR---RSDEPITPWNFKDVVDEEA 489
WP_007896501   422 HAILRRQBKYYPFLAE--QKE KIEQLLCFRIPYYVGPL AKGGn--SSFAWLKR---RSDEPITPWNFKDVVDEEA 489
EFR44625       374 HAILRRQBKYYPFLAE--QKE KIEQLLCFRIPYYVGPL ARDN--RDFSWLTR---NSDEPIRPWNFEEIVDKAR 441
WP_002897477   420 NAILRRQGEHYLFLKE--NRE KIEKILAFRIPYYVGPL ARGN--RDFAWLTR---NSDQAIRPWNFEEVVDKAS 486
WP_002906454   421 NAILRRQGEHYPFLKE--NAE KIEKILTFRIPYYVGPL ARGN--SRFAWASY---NSNERMTPWNFDNVLDKTS 487
WP_009729476   421 KAILRRQGEHYPFLKE--NKE KIQQLTFKIPYYVGPL ARGN--SRFAWASY---NSNERMTPWNFDNVIDKTS 487
CQR24647       421 NAILRRQGEHYPFLKE--NKE KIEKILTFRIPYYVGPL ARGN--RDFAWLTR---NSDQAIRPWNFEEIVDQAS 487
WP_000666813   420 HAIIRRQAEFYPFLVE--NQD KIEKILTFRIPYYVGPL ARGK--RDFAWLNR---KSDEKIRPWNFDEMVDKET 486
WP_009754323   420 HAIIRRQAEFYPFLVE--NQD KIEKILTFRIPYYVGPL ARGK--SEFAWLNR---KSDEKIRPWNFDEMVDKET 486
WP_044674937   420 HAIIRRQAEFYPFLVE--NQD KIEKILTFRIPYYVGPL ARGK--SEFAWLNR---KSDEKIRPWNFDEMVDKET 486
WP_044676715   420 HAIIRRQAEFYPFLVE--NQD KIEKILTFRIPYYVGPL ARGK--SEFAWLNR---KSDEKIRPWNFDEMVDKET 486
```

-continued

| ID | | | | | |
|---|---|---|---|---|---|
| WP_044680361 | 420 | HAIIRRQAEFYPPLVE--NQD | KIEKILTFRIPYYVGPL | ARGK--SEFAWLNR---KSDEKIRPWNFDEMVDKET | 486 |
| WP_044681799 | 420 | HAIIRRQAEFYPFIVE--NQD | KIEKILTFRIPYYVGPL | ARGK--SEFAWLNR---KSDEKIRPWNFDEMVDKET | 486 |
| WP_049533112 | 420 | HAILRRQEEHYPFLKE--NQD | KIEKILTFRIPYYVGPL | ARKG--SRFAWAEY---KADEKITPWNFDDILDKEK | 486 |
| WP_029090905 | 404 | VAILENQATYYPELLE--QKD | NIHKLLTFRIPYYVGPL | ADQKd-SEFAWMVR---KQAGKITPFNFEEMVDIDA | 471 |
| WP_006506696 | 430 | IKIIDNQAEYYPILKE--KRE | QLLSILTFRIPYYFGPL | ETSEh----AWIKrlegKENQRILPWNYQDIVDVDA | 498 |
| AIT42264 | 420 | TAVLDQQEKHYSFLKE--NRD | KIISLLTFRIPYYVGPL | ARG-n-SRFAWMTR---KSEETITPWNFEEVVDKGA | 486 |
| WP_034440723 | 426 | HAILRRQEDFYPFIKD--NRE | KIEKILTFRIPYYVGPL | AKGE--SRFAWLER---sNSEEKIKPWNEDKIVDIDK | 493 |
| AKQ21048 | 420 | HAILRRQEDFYPFLKD--NRE | KIEKILTFRIPYYVGPL | ARG-n-SRFAWMTR---KSEETTPWNFEEVVDKGA | 486 |
| WP_004636532 | 421 | QAILDRQSQYYPFLAE--NRD | KIESLVTFRIPYYVGPL | TVSDq-SEFAWMER---QSDEPIRPWNFDEIVNKER | 488 |
| WP_002364836 | 428 | QAIHRQAAYYPPFLKE--NQE | KIEQLVTFRIPYYVGPL | SKGDA-STFAWLKR---QSEEPIRPWNLQETVDLDQ | 495 |
| WP_016631044 | 379 | QAIHRQAAYYPPFLKE--NQE | KIEQLVTFRIPYYVGPL | SKGDA-STFAWLKR---QSEEPIRPWNLQETVDLDQ | 446 |
| EMS75795 | 163 | KAIIERQKPYYPSLEE--ARD | KMIRLLTFRIPYYGPL | AQGEt-SSFAWLER---KTPEKVTPWNATEVIDYSA | 231 |
| WP_002373311 | 428 | QAIHRQAAYYPPFLKE--NQE | KIEQLVTFRIPYYVGPL | SKGDA-STFAWLKR---QSEEPIRPWNLQETVDLDQ | 495 |
| WP_002378009 | 428 | QAIHRQAAYYPPFLKE--NQE | KIEQLVTFRIPYYVGPL | SKGDA-NTFAWLKR---QNEKPIRPWNLQETVDLDQ | 495 |
| WP_002407324 | 428 | QAIHRQAAYYPPFLKE--NQE | KIEQLVTFRIPYYVGPL | SKGDA-STFAWLKR---QSEEPIRPWNLQETVDLDQ | 495 |
| WP_002413717 | 428 | QAIHRQAAYYPPFLKE--NQE | KIEQLVTFRIPYYVGPL | SKGDA-STFAWLKR---QSEEPIRPWNLQETVDLDQ | 495 |
| WP_010775580 | 430 | QAIHRQAAYYPPFLKE--NQK | KIEQLVTFRIPYYVGPL | SKGDA-STFAWLKR---QSEEPIRPWNLQETVDLDQ | 497 |
| WP_010818269 | 428 | QAIHRQAAYYPPFLKE--NQE | KIEQLVTFRIPYYVGPL | SKGDA-STFAWLKR---QSEEPIRPWNLQETVDLDQ | 495 |
| WP_010824395 | 428 | QAIHRQAAYYPPFLKE--NQE | KIEQLVTFRIPYYVGPL | SKGDA-STFAWLKR---QSEEPIRPWNLQETVDLDQ | 495 |
| WP_016622645 | 428 | QAIHRQAAYYPPFLKE--NQE | KIEQLVTFRIPYYVGPL | SKGDA-STFAWLKR---QSEEPIRPWNLQETVDLDQ | 495 |
| WP_033624816 | 428 | QAIHRQAAYYPPFLKE--NQK | KIEQLVTFRIPYYVGPL | SKGDA-STFAWLKR---QSEEPIRPWNLQETVDLDQ | 495 |
| WP_033625576 | 428 | QAIHRQAAYYPPFLKE--NQE | KIEQLVTFRIPYYVGPL | SKGDA-STFAWLKR---QNEKPIRPWNLQETVDLDQ | 495 |
| WP_033789179 | 428 | QAIHRQAAYYPPFLKE--EQE | KLESLLTFRIPYYVGPL | SKGDA-STFAWLIR---KSEEKIKPWNLPEIVDMEG | 495 |
| WP_002310644 | 425 | RAIANQKKHYPPFLKE--EQE | KLESLLTFKIPYYVGPL | AKKQenSPFAWLIR---KSEEKIKPWNLPEIVDMEG | 492 |
| WP_002312694 | 425 | RAIANQKKHYPPFLKE--EQE | KLESLLTFKIPYYVGPL | AKKQenSPFAWLIR---KSEEKIKPWNLPEIVDMEG | 493 |
| WP_002314015 | 425 | RAIANQKKHYPPFLKE--EQE | KLESLLTFKIPYYVGPL | AKKQenSPFAWLIR---KSEEKIKPWNLPEIVDMEG | 493 |
| WP_002320716 | 424 | RAIANQKKHYPPFLKE--EQE | KLESLLTFKIPYYVGPL | AKKQenSPFAWLIR---KSEEKIKPWNLPEIVDMEG | 492 |
| WP_002330729 | 425 | RAIANQKKHYPPFLKE--EQE | KLESLLTFKIPYYVGPL | AKKQenSPFAWLIR---KSEEKIKPWNLPEIVDMEG | 493 |
| WP_002335161 | 425 | RAIANQKKHYPPFLKE--EQE | KLESLLTFKIPYYVGPL | AKKQenSPFAWLIR---KSEEKIKPWNLPEIVDMEG | 493 |
| WP_002345439 | 425 | RAIANQKKHYPPFLKE--EQE | KLESLLTFKIPYYVGPL | AKKQenSPFAWLIR---KSEEKIKPWNLPEIVDMEG | 493 |
| WP_034867970 | 418 | KAIIDQQKQHYPPFLEE--EQP | KIIALFKRIPYYVGPL | AKEQeaSSFAWIER---KTAEKINPWNFSEVVDIEK | 486 |
| WP_047937432 | 425 | RAIANQKKHYPPFLKE--AGP | KLESLLTFKIPYYVGPL | AKKQenSPFAWLIR---KSEEKIKPWNLPEIVDMEG | 493 |
| WP_010720994 | 418 | KAIIDQQKQHYPPFLEE--AGP | KIIALFKRIPYYVGPL | AKEQeaSSFAWIER---KTAEKINPWNFSEVVDIEK | 486 |
| WP_010737004 | 418 | KAIIDQQKQHYPPFLEE--AGP | KIIALFKRIPYYVGPL | AKEQeaSSFAWIER---KTAEKINPWNFSEVVDIEK | 486 |
| WP_034700478 | 418 | KAIIDQQKQHYPPFLEE--AGP | KIIALFKRIPYYVGPL | AKEQeaSSFAWIER---KTAEKINPWNFSEVVDIEK | 486 |
| WP_072090003 | 422 | RAILRKQEKYYSFLKE--NHE | KIEQIFKVRIPYYVGPL | AKHNeqSRFAWNIR---KSDEPIRPWMNDVVDENA | 490 |
| WP_023519017 | 418 | REIMDRQKRFYPPFLKE--AQG | KIEKILTFRIPYYVGPL | AQPGq-SPFAWIRK---KSPSQTPWNFAEVVDKEN | 485 |
| WP_010770040 | 423 | EMKQLVTFRIPYYVGPL---INPN | ADGN--SPFAWLER---ISSEPIRPGNLAEVVDIKK | 489 |
| AKP02966 | 419 | KAILHHQAMYYPFLQE--KFS | NFVDLLTFRIPYYVGPL | ANGN--SRFSWLSR---KSDEPIRPWNLAEVVDLSK | 485 |
| WP_048604708 | 418 | KAIIDQQKQHYPPFLEE--SKE | KMIQLLTFRIPYYVGPL | AQDKet-SSFAWLER---KTTEKIKPWNAKDVIDYGA | 486 |
| WP_010750235 | 459 | HAILRRQEDFYPFLKE--NRE | KIEKILTFRIPYYVGPL | ARG-n-SRFAWMTR---KSEETTPWNFEEVVDKGA | 525 |
| AII16583 | 436 | NKILENQSVYYSDLKD--NED | KIRSLLTFRIPYYFGPL | ITKDr-QFDWIIKegKENERILPWNANEIVDVDK | 506 |
| WP_029073316 | 436 | NKILENQSVYYSDLKD--NED | KIRSLLTFRIPYYFGPL | ITKDr-QFDWIIKegKENERILPWNANEIVDVDK | 506 |
| WP_031589969 | 418 | VAIVENQGKYYPFLRE--NKD | KFPEKLNFRIPYYVGPL | ARGN--SKFAWLTR---a-GEGKITPYNFDEMIDKET | 484 |
| KDA45870 | 426 | DRIIENQQQYYPWLAE--INPN | KLDELVAFRVPYYVGPL | KAEGQTPWNFDDKVDRQA | 509 |
| WP_039099354 | 416 | EKIIDNQSQYYPFLKE--NKE | KLLSILSFRIPYYVGPL | -QSSekNPFAWMER---KSNGHARPWNFDEIVDREK | 483 |
| AKP02966 | 426 | EAILHQQAKYYPPFLKE--NYD | KIKSLVTFRIPYYVGPL | ANGQ--SEFAWLTR---KADGEIRPWNIEEKVDFGK | 492 |
| WP_010991369 | 426 | EAILHQQAKYYPPFLKE--NYD | KIKSLVTFRIPYYVGPL | ANGQ--SEFAWLTR---KADGEIRPWNIEEKVDFGK | 492 |
| WP_033838504 | 429 | EAILHQQAKYYPPFLKE--NYD | KIKSLVTFRIPYYVGPL | ANGQ--SEFAWLTR---KADGEIRPWNIEEKVDFGK | 495 |
| EHN60060 | 195 | EAILHQQAKYYPPFLKE--NYD | KIKSIVTFRIPYYVGPL | ANGQ--SEFAWLTR---KADGEIRPWNIEEKVDFGK | 261 |
| EFR89594 | 426 | EAILHQQAKYYPPFLRK--DYE | KIRSLVTFRIPYFIGPL | ANGQ--SDFAWLTR---KADGEIRPWNIEEKVDFGK | 492 |
| WP_038409211 | 45 | EAILHQQAKYYPPFLKE--DYE | KIRSLVTFRIPYFIGPL | ANGQ--SDFAWLTR---KADGEIRPWNIEEKVDFGK | 111 |
| EFR95520 | 426 | EAIIHQQAKYYPPFLKE--DYD | KIKSLVTFRIPYFGPL | ANGQ--SEFAWLTR---KADGEIRPWNIEEKVDFGK | 492 |
| WP_003723650 | | | | | |

-continued

```
WP_003727705  426  EAILHQQAKYYPPLRE--GYD  KIKSLVTFRIPYFVGPL  ANGQ--SEFAWLTR---KDDGEIRPWNIEEKVDFGK  492
WP_003730785  426  EAILHQQAKYYPPFLRE--GYD  KIKSLVTFRIPYFVGPL  ANGQ--SEFAWLTR---KDDGEIRPWNIEEKVDFGK  492
WP_003733029  426  EAILHQQAKYYPPFLRE--DYE  KIKSLVTFRIPYFVGPL  AKGQ--SEFAWLTR---KADGEIRPWNIEEKVDFGK  492
WP_003739838  426  EAILHQQAKYYPPFLKE--AYD  KIKSLVTFRIPYFVGPL  ANGQ--SDFAWLTR---KADGEIRPWNIEEKVDFGK  492
WP_014601172  426  EAILHQQAKYYPPFLRE--DYE  KIKSLVTFRIPYFVGPL  AKGQ--SEFAWLTR---KADGEIRPWNIEEKVDFGK  492
WP_023548323  426  EAILHQQAKYYTPFLKE--DYE  KIKSLVTFRIPYFVGPL  ANGQ--SEFAWLTR---KADGEIRPWNIEEKVDFGK  492
WP_031665337  426  EAILHQQAKYYPPFLRE--DYE  KIKSLVTFRIPYFVGPL  ANGQ--SEFAWLTR---KADGEIRPWNIEEKVDFGK  492
WP_031669209  426  EAILHQQAKYYPPFLRE--DYE  KIKSLVTFRIPYFVGPL  ANGQ--SEFAWLTR---KADGEIRPWNIEEKVDFGK  492
WP_033920898  426  EAILHQQAKYYPPFLRE--DYE  KIKSLVTFRIPYFVGPL  AKGQ--SEFAWLTR---KADGEIRPWNIEEKVDFGK  492
AKI42028      426  EAILHQQAKYYPPFLRE--DYE  KIKSLVTFRIPYFVGPL  AKGQ--SEFAWLTR---KADGEIRPWNIEEKVDFGK  495
AKI50529      429  EAILHQQAKYYPPFLRE--DYE  KIKSLVTFRIPYFVGPL  AKGQ--SEFAWLTR---KADGEIRPWNIEEKVDFGK  495
EFR83390                                                                                      
WP_046323366  426  EAILHQQAKYYPPFLKV--DYE  KIKSLVTFRIPYFVGPL  ANGQ--SEFSWLTR---KADGEIRPWNIEEKVDFGK  492
AKE81011      436  HAILRRQEDFYPPLKD--NRE  KIKILTFRIPYYFGPL  ARG-n-SRFAWMTR---KSEETITPWNFEEVVDKGA  502
CUO82355      434  IKIIDNQAKYYPVLKE--KRE  QLLSILTFRIPYYFGPL  ETSEh--AWIKRleGKENQRILPWNYQDTVDVDA    502
WP_031628887  435  IQIIDNQSVYYPQLKE--NRD  KLISILEFRIPYYFGPL  AHSE--FAWIKKfedKQKERLPWNYDQIVDIDA     503
AGZ01981      453  HAILRRQEDFYPPLKD--NRE  KIEKILTFRIPYYVGPL  ARG-n-SRFAWMTR---KSEETITPWNFEEVVDKGA  519
AKA60242      420  HAILRRQEDFYPPLKD--NRE  KIEKILTFRIPYYVGPL  ARG-n-SRFAWMTR---KSEETITPWNFEEVVDKGA  486
AKS40380      420  HAILRRQEDFYPPLKD--NRE  KIEKILTFRIPYYVGPL  ARG-n-SRFAWMTR---KSEETITPWNFEEVVDKGA  486
4UN5_B        424  HAILRRQEDFYPPLKD--NRE  KIEKILTFRIPYYVGPL  ARG-n-SRFAWMTR---KSEETITPWNFEEVVDKGA  490

WP010922251   487  SAQSFIERMTNFDKNLPHSLLYEYFTVYNELTKVKVT--EGMRKPaFLS[Q]kKKAIVDLLFK--TNR-KVTV  561

WP_039695303  490  SAEKFITRMTLNDLYLPEEKVLPKHSHVYETYAVYNELTKIKVN--EQGKES-FFDSNMKQEIFDHVFK--ENR-KVTK  563
WP_045635197  487  SAEDFINKMTNYDLYLPEEKVLPKHSLLYETFAVYNELTKVFIA--EGLRDYqFLDSGQKKQIVNQLFK--ENR-KVTE  561
5AXW_A        230  --KEWYEMLMGHCTYFEELRSVKYAYNADLYNALNDLNNLVITR--DENEKLeYYE---KPQIIENVFK--QKK-KPTL  299
WP_009880683  171  SAQSFIERMTNFDKNLPHSLLYEYFTVYNELTKVKVT--EGMRKPaFLSGEQKKAIVDLLFK--TNR-KVTV  245
WP010922251   487  SAQSFIERMTNFDKNLPHSLLYEYFTVYNELTKVKVT--EGMRKPaFLSGEQKKAIVDLLFK--TNR-KVTV  561
WP_011054416  487  SAQSFIERMTNFDKNLPHSLLYEYFTVYNELTKVKVT--EGMRKPaFLSGEQKKAIVDLLFK--TNR-KVTV  561
WP011284745   487  SAQSFIERMTNFDKNLPHSLLYEYFTVYNELTKVKVT--EGMRKPaFLSGEQKKAIVDLLFK--TNR-KVTV  561
WP011285506   487  SAQSFIERMTNFDKNLPHSLLYEYFTVYNELTKVKVT--EGMRKPaFLSGEQKKAIVDLLFK--TNR-KVTV  561
WP011527619   487  SAQSFIERMTNFDKNLPHSLLYEYFTVYNELTKVKVT--EGMRKPaFLSGEQKKAIVDLLFK--TNR-KVTV  561
WP012560673   487  SAQSFIERMTNFDKNLPHSLLYEYFTVYNELTKVKVT--EGMRKPeFLSGEQKKAIVDLLFK--TNR-KVTV  561
WP_014407541  487  SAQSFIERMTNFDKNLPHSLLYEYFTVYNELTKVKVT--EGMRKPaFLSGEQKKAIVDLLFK--TNR-KVTV  561
WP_020905136  487  SAQSFIERMTNFDKNLPHSLLYEYFTVYNELTKVKVT--EGMRKPaFLSGEQKKAIVDLLFK--TNR-KVTV  561
WP_023080005  487  SAQSFIERMTNFDKNLPHSLLYEYFTVYNELTKVKVT--EGMRKPaFLSGEQKKAIVDLLFK--TNR-KVTV  561
WP_023610282  487  SAQSFIERMTNFDKNLPHSLLYEYFTVYNELTKVKVT--EGMRKPaFLSGEQKKAIVDLLFK--TNR-KVTV  561
WP_030125963  487  SAQSFIERMTNFDKNLPHSLLYEYFTVYNELTKVKVT--EGMRKPaFLSGEQKKAIVDLLFK--TNR-KVTV  561
WP_030126706  487  SAQSFIERMTNFDKNLPHSLLYEYFTVYNELTKVKVT--EGMRKPaFLSGEQKKAIVDLLFK--TNR-KVTV  561
WP_031488318  487  SAQSFIERMTNFDKNLPHSLLYEYFTVYNELTKVKVT--EGMRKPaFLSGEQKKAIVDLLFK--TNR-KVTV  561
WP_032460140  487  SAQSFIERMTNFDKNLPHSLLYEYFTVYNELTKVKVT--EGMRKPaFLSGEQKKAIVDLLFK--TNR-KVTV  561
WP_032461047  487  SAQSFIERMTNFDKNLPHSLLYEYFTVYNELTKVKVT--EGMRKPaFLSGEQKKAIVDLLFK--TNR-KVTV  561
WP_032462016  487  SAQSFIERMTNFDKNLPHSLLYEYFTVYNELTKVKVT--EGMRKPaFLSGEQKKAIVDLLFK--TNR-KVTV  561
WP_032462936  487  SAQSFIERMTNFDKNLPHSLLYEYFTVYNELTKVKVT--EGMRKPaFLSGEQKKAIVDLLFK--TNR-KVTV  561
WP_032464890  487  SAQSFIERMTNFDKNLPHSLLYEYFTVYNELTKVKVT--EGMRKPaFLSGEQKKAIVDLLFK--TNR-KVTV  561
WP_033888930  312  SAQSFIERMTNFDKNLPHSLLYEYFTVYNELTKVKVT--EGMRKPaFLSGEQKKAIVDLLFK--TNR-KVTV  386
WP_038431314  487  SAQSFIERMTNFDKNLPHSLLYEYFTVYNELTKVKVT--EGMRKPaFLSGEQKKAIVDLLFK--TNR-KVTV  561
WP_038432938  487  SAQSFIERMTNFDKNLPHSLLYEYFTVYNELTKVKVT--EGMRKPaFLSGEQKKAIVDLLFK--TNR-KVTV  561
WP_038434062  487  SAQSFIERMTNFDKNLPHSLLYEYFTVYNELTKVKVT--EGMRKPaFLSGEQKKAIVDLLFK--TNR-KVTV  561
BAQ51233      398  SAQSFIERMTNFDKNLPHSLLYEYFTVYNELTKVKVT--EGMRKPaFLSGEQKKAIVDLLFK--TNR-KVTV  472
KGE60162
KGE60856
```

| | | | |
|---|---|---|---|
| WP_002989955 | 487 | SAQSFIERMTNFPDKNLPNEKVLPKHSLLYEYFTVYNELTKVKYVT--EGMRKPaFLSGEQKKAIVDLLFK--TNR-KVTV | 561 |
| WP_003030002 | 487 | SAEKFITRMTLNDLYLPEEKVLPKHSLLYETFTVYNELTKVKYVN--EQGEAK-FFDANMKQEIFDHVFK--ENR-KVTK | 560 |
| WP_003065552 | 490 | SAEKFITRMTLNDLYLPEEKVLPKHSHVYETYAVYNELTKIKYVN--EQGKDS-FFDSNMKQEIFDHVFK--ENR-KVTK | 563 |
| WP_001040076 | 488 | SAEAFIHRMTIHRMTNNDLYLPEEKVLPKHSLLYEKFTVYNELTKVRFLA--EGFKDPqFLNRKQKETFNSLFK--EKR-KVSK | 562 |
| WP_001040078 | 488 | SAEAFIHRMTNNDLYLPEEKVLPKHSLLYEKFTVYNELTKVRYKN--EQGETY-FFDSNIKQEIFDGVFK--EHR-KVSK | 561 |
| WP_001040080 | 488 | SAEAFIHRMTNNDLYLPEEKVLPKHSLLYEKFTVYNELTKVRYKN--EQGETY-FFDSNIKQEIFDGVFK--EHR-KVSK | 561 |
| WP_001040081 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040083 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040085 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040087 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040088 | 488 | SAEAFIHRMTNNDFYLPEEKVLPKHSLLYEKFTVYNELTKIKYVN--EQGKDS-FFDSNMKQEIFDHVFK--ENR-KVSK | 561 |
| WP_001040089 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040090 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040091 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040092 | 488 | SAEAFIHRMTNNDFYLPEEKVLPKHSLLYEKFTVYNELTKVRYKN--EQGETY-FFDSNVKQEIFDGVFK--EHR-KVSK | 561 |
| WP_001040094 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040095 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040096 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040097 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040098 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040099 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040100 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_001040104 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040105 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040106 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040107 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040108 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040109 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_001040110 | 488 | SAEAFIHRMTNNDFYLPEEKVLPKHSLLYEKFTVYNELTKVRYKN--EQGETY-FFDSNVKQEIFDGVFK--EHR-KVSK | 561 |
| WP_015058523 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_017643650 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_017647151 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_017648376 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_017649527 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_017771611 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_017771984 | 488 | SAEAFIHRMTNNDFYLPEEKVLPKHSLLYEKFTVYNELTKVRYKN--EQGETY-FFDSNIKQEIFDGVFK--EHR-KVSK | 561 |
| CFQ25032 | 488 | SAEAFIHRMTNNDFYLPEEKVLPKHSLLYEKFTVYNELTKVRYKN--EQGETY-FFDSNIKQEIFDGVFK--EHR-KVSK | 561 |
| CFV16040 | 488 | SAEAFIHRMTNNDLYLPEEKVLPKHSLLYEKFTVYNELTKVRFLA--EGFKDFqFLNRKQKETIENSLEK--EKR-KVTE | 562 |
| KLJ37842 | 488 | SAEAFIHRMTNNDFYLPEEKVLPKHSLLYEKFTVYNELTKVRYKN--EQGETY-FFDSNIKQEIFDGVFK--EHR-KVSK | 561 |
| KLJ72361 | 488 | SAEAFIHRMTNNDFYLPEEKVLPKHSLLYEKFTVYNELTKVRYKN--EQGETY-FFDSNIKQEIFDGVFK--EHR-KVSK | 561 |
| KLL20707 | 488 | SAEAFIHRMTNNDFYLPEEKVLPKHSLLYEKFTVYNELTKVRYKN--EQGETY-FFDSNIKQEIFDGVFK--EHR-KVSK | 561 |
| KLL42645 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_047207273 | 488 | SAEAFIHRMTNNDLYLPEEKVLPKHSLLYEKFTVYNELTKVRFLA--EGFKDFqFLNRKQKETIENSLEK--EKR-KVTE | 562 |
| WP_047209694 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_050198062 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_050201642 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_050204027 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_050881965 | 488 | SAEAFIHRMTNNDFYLPEEKVLPKHSLLYEKFTVYNELTKVRYKN--EQGETY-FFDSNIKQEIFDGVFK--EHR-KVSK | 561 |
| WP_050886065 | 488 | SAEAFIHRMTNNDFYLPEEKVLPKHSLLYEKFTVYNELTKVRYKN--EQGETY-FFDSNVKQEIFDGVFK--EHR-KVSK | 561 |
| AHN30376 | 488 | SAEAFIHRMTNNDFYLPEEKVLPKHSLLYEKFTVYNELTKVRYKN--EQGETY-FFDSNIKQEIFDGVFK--EHR-KVSK | 561 |
| EA078426 | 488 | SAEAFIHCMTNNDFYLPEEKVLPKHSLLYEKFTVYNELTKVRYKN--EQGETY-FFDSNIKQEIFDGVFK--EYR-KVSK | 561 |
| CCW42055 | 488 | SAEAFIHRMTNNDFYLPEEKVLPKHSLLYETFTVYNELTKVKYVN--EQGEAK-FFDANMKQEIFDHVFK--ENR-KVTK | 561 |
| WP_003041502 | 487 | SAEKFITRMTLNDLYLPEEKVLPKHSLLYETFTVYNELTKVKYVN--EQGEAK-FFDANMKQEIFDHVFK--ENR-KVTK | 560 |

| | | |
|---|---|---|
| WP_037593752 | 488 SAEKFITRMTLNDLYLPEEKVLPKHSPLYETFTVYNELTKVKYVN-EQGEAK-FFDTNMKQEIFDHVFK--ENR-KVTK | 561 |
| WP_049516684 | 488 SAEKFITRMTLNDLYLPEEKVLPKHSPLYETFTVYNELTKVKYVN-EQGEAK-FFDTNMKQEIFDHVFK--ENR-KVTK | 561 |
| GAD46167 | 487 SAEKFITRMTLNDLYLPEEKVLPKHSPLYETFTVYNELTKVKYVN-EQGEAK-FFDTNMKQEIFDHVFK--ENR-KVTK | 560 |
| WP_018363470 | 488 SAEKFITRMTLNDLYLPEEKVLPKHSHVYETFAVYNELTKVKYVT-EQGKDS-FFDSNMKQEIFDHVFK--ENR-KVTK | 561 |
| WP_003043819 | 497 SAQSFIERMTLNDLYLPDEQLPNKKVLPKHSPLYEAFTVYNELTKVKYVN-ERMRKPeFLSGEQKAIVDLLFK--TNR-KVTV | 571 |
| WP_066269658 | 487 SAEKFITRMTLNDLYLPEEKVLPKHSLLYEIFTVYNELTKVKYVN-EQGEAK-FFDTNMKQEIFDHVFK--ENR-KVTV | 560 |
| WP_048800889 | 487 SAEKFITRMTLNDLYLPEEKVLPKHSLLYEIFTVYNELTKVKYVN-EQGEAK-FFDANMKQEIFDHVFK--ENP-KVTK | 560 |
| WP_012767106 | 487 SAQSFIERMTNFDKNLPNEKVLPKHSLLYEYFTVYNELTKVKYVT-EGMRKPeFLSGKQKEAIVDLLFK--TNR-KVTV | 560 |
| WP_014612333 | 487 SAQSFIERMTNFDKNLPNEKVLPKHSLLYEYFTVYNELTKVKYVT-EGMRKPeFLSGKQKEAIVDLLFK--TNR-KVTV | 560 |
| WP_015017095 | 487 SAQSFIERMTNFDKNLPNEKVLPKHSLLYEYFTVYNELTKVKYVT-EGMRKPeFLSGKQKEAIVDLLFK--TNR-KVTV | 560 |
| WP_015057649 | 487 SAQSFIERMTNFDKNLPNEKVLPKHSLLYEYFTVYNELTKVKYVT-EGMRKPeFLSGKQKEAIVDLLFK--TNR-KVTV | 560 |
| WP_048327215 | 487 SAQSFIERMTNFDKNLPNEKVLPKHSLLYEYFTVYNELTKVKYVT-EGMRKPeFLSGKQKEAIVDLLFK--TNR-KVTV | 560 |
| WP_049519324 | 487 SAQSFIERMTNFDKNLPNEKVLPKHSLLYEYFTVYNELTKVKYVT-EGMRKPaFLSGEQKAIVDLLFK--TNR-KVTV | 560 |
| WP_012515931 | 487 SAQIFIEKMTKNDLYLPNEKVLPKHSLLYEYFTVYNELTKVKYAT-EGMTRPqFLSADQKQAIVDLLFK--TNR-KVTV | 560 |
| WP_021320964 | 487 SAQIFIEKMTKNDLYLPNEKVLPKHSLLYEYFTVYNELTKVKYAT-EGMTRPqFLSADQKQAIVDLLFK--TNR-KVTV | 560 |
| WP_037581760 | 487 SAQIFIEKMTKNDLYLPEEKVLPKHSLLYETFTVYNELTKVKYAT-EGMTRPqFLSADQKQAIVDLLFK--TNR-KVTV | 560 |
| WP_004232481 | 487 SAEKFITRMTLNDLYLPEEKVLPKHSVYETFAVYNELTKVKYVN-EQGKSF-FFDANMKQEIFDHVFK--TNR-KVTK | 560 |
| WP_009854540 | 488 SAEKFITRMTLNDLYLPEEKVLPKHSVYETYAVYNELTKVKYVN-EQGKES-FFDSNMKQEIFDHVFK--ENR-KVTK | 561 |
| WP_012962174 | 488 SAEKFITRMTLNDLYLPEEKVLPKHSVYETYAVYNELTKVKYVN-EQGKES-FFDANMKQEIFEHVFK--ENR-KVTK | 561 |
| WP_039695303 | 490 SAEKFITRMTLNDLYLPEEKVLPKHSVYETFAVYNELTKIKVKYVN-EQGKES-FFDSNMKQEIFDHVFK--ENR-KVTK | 563 |
| WP_014334983 | 487 SAEKFITRMTLNDLYLPEEKVLPKHSHVYETFTVYNELTKIKVKVN-EQGESF-FFDANMKQEIFDHVFK--ENR-KVTV | 560 |
| WP_003099269 | 487 SARAFIERMTNFDTYLPEEKVLPKHSPLYEMFMVYNELTKVKYQT-EGMKRPvFLSSEDKEEIVNLLFK--KER-KVTV | 561 |
| AHY15608 | 487 SARAFIERMTNFDTYLPEEKVLPKHSPLYEMFMVYNELTKVKYQT-EGMKRPvFLSSEDKEEIVNLLFK--KER-KVTV | 561 |
| AHY17476 | 487 SARAFIERMTNFDTYLPEEKVLPKHSPLYEMFMVYNELTKVKYQT-EGMKRPvFLSSEDKEEIVNLLFK--KER-KVTV | 560 |
| ESR09100 | --- | --- |
| AGM98575 | 487 SARAFIERMTNFDTYLPEEKVLPKHSPLYEMFMVYEMFMVYEKFTVYEKFIA-EGMKRPvFLSSEDKEEIVNLLFK--KER-KVTV | 561 |
| ALF27331 | 500 SASRFILHDLYLPNQKVLPRHSLLYEKYTVFENELTKVRFTP-EGGKEV-YFSKTDKENIFDSLFK--RYR-KVTK | 573 |
| WP_018372492 | 488 SAEDFINKMTNYDLYLPNQKVLPKHSLLYEKFTVFENELTKVKYKT-EGQKTA-FFDANMKQEIFDGVFK--EKR-KVTE | 562 |
| WP_045618028 | 488 SAEDFINKMTNYDLYLPNQKVLPKHSLLYETFAVYNELTKVKFIA-EGLRDYqFLDSGQKQKKQIVNQLFK--ENR-KVTE | 561 |
| WP_045635197 | 487 SAEAFINRMTNYDLYLPNQKVLPKHSLLYEKFTVYEKFIA-EGLRDYqFLDSGQKKQIVNQLFK--VYR-KVTK | 560 |
| WP_002263549 | 487 SAEAFINRMTNYDLYLPNQKVLPKHSLLYEKFTVYEKFTKVKYKT-EQGKTA-FFDANMKQEIFDGVFK--VYR-KVTK | 560 |
| WP_002263887 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002264920 | 487 SVEAFINRMTNYDLYLPNQKVLPKHSLLYEKFTVYNELTKVKYKT-EQGKTA-FFDANMKQEIFDGVFK--VYR-KVTK | 560 |
| WP_002269043 | 487 SVEAFINRMTNYDLYLPNQKVLPKHSLLYEKFTVYNELTKVKYKT-EQGKTA-FFDANMKQEIFDGVFK--VYR-KVTK | 560 |
| WP_002269448 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002271977 | 487 SAEAFINRMTNYDLYLPNQKVLPKHSLLYEKFTVFENELTKVKYKT-EGGKEV-YFSKTDKENIFDSLFK--RYR-KVTK | 560 |
| WP_002272766 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002273241 | 487 SAEDFINKMTNYDLYLPNQKVLPKHSLLYEKFTVYNELTKVKYKT-EQGKTA-FFDANMKQEIFDGVFK--EKR-KVTE | 560 |
| WP_002275430 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002276448 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002277050 | 487 SAQAFIEHMTNYDLYLPNQKVLPKHSLLYEKFTVYNELTKIKVKVT-EIGEAK-FFDANLKQEIFDGLFK--HER-KVTK | 560 |
| WP_002273364 | 487 SAEAFINRMTNYDLYLPNQKVLPKHSLLYEKFTVYNELTKVKYKT-EQGETA-FFDANMKQEIFDGVFK--VYR-KVTK | 560 |
| WP_002279025 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002279859 | 487 SVEAFINRMTNYDLYLPNQKVLPKHSLLYEKFTVYNELTKVKYKT-EQGKTA-FFDANLKQEIFDGLFK--VYR-KVTK | 560 |
| WP_002280230 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002281696 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002282247 | 487 SAQAFINRMTNYDLYLPNQKVLPKHSLLYEKFTVYNELTKIKVKVT-EIGEAK-FFDANLKQEIFDGLFK--HER-KVTK | 560 |
| WP_002282906 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002283846 | 487 SVEAFINRMTNYDLYLPNQKVLPKHSLLYEKFTVYNELTKVKYKT-EQGKTA-FFDANMKQEIFDGVFK--VYR-KVTK | 560 |
| WP_002287255 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002288990 | 487 SVEAFINRMTNYDLYLPNQKVLPKHSLLYEKFTVYNELTKVKYKT-EQGKTA-FFDANMKQEIFDGVFK--VYR-KVTK | 560 |
| WP_002289641 | 487 SAEAFINRMTNYDLYLPNQKVLPKHSLLYEKFTVYNELTKVKYKT-EQGKTA-FFDANMKQEIFDGVFK--VYR-KVTK | 560 |
| WP_002290427 | 487 SAEAFINRMTNYDLYLPNQKVLPKHSLLYEKFTVYNELTKVKYKT-EQGKTA-FFDANMKQEIFDGVFK--VYR-KVTK | 560 |

```
                                                        -continued

WP_002295753  487  SAEAFIINRMTNYDLYLPNQKVLPKHSLLYEKFTVYNELTKVYKT- -EQGKTA-FFDANMKQEIFDGVFK- -VYR-KVTK  560
WP_002296423  487  SVEAFIINRMTNYDLYLPNQKVLPKHSLLYEKFTVYNELTKVYKT- -EQGKTA-FFDANMKQEIFDGVFK- -VYR-KVTK  560
WP_002304487  497  SAEKFITRMTLNDLYLPEEKVLPKHSLLYETFTVYNELTKVYVN- -EQGEAK-FFDANMKQEIFDHVFK- -ENR-KVTK  570
WP_002305844  487  SAEAFIINRMTNYDLYLPNQKVLPKHSLLYEKFTVYNELTKVYKT- -EQGKTA-FFDANMKQEIFDGVFK- -VYR-KVTK  560
WP_002307203  487  SVEAFIINRMTNYDLYLPNQKVLPKHSLLYEKFTVYNELTKVYKT- -EQGKTA-FFDANMKQEIFDGVFK- -VYR-KVTK  560
WP_002310390  487  SAEAFIINRMTNYDLYLPNQKVLPKHSLLYEKFTVYNELTKVYKT- -EQGKTA-FFDANMKQEIFDGVFK- -VYR-KVTK  560
WP_002352408  487  SAEAFIINRMTNYDLYLPNQKVLPKHSLLYEKFTVYNELTKVYKT- -EQGKTA-FFDANMKQEIFDGVFK- -VYR-KVTK  560
WP_012997688  487  SAEAFIINRMTNYDLYLPNQKVLPKHSLLYEKFTVYNELTKVYKT- -EQGKTA-FFDANMKQEIFDGVFK- -VYR-KVTK  560
WP_014677909  487  SVEAFIINRMTNYDLYLPNQKVLPKHSLLYEKFTVYNELTKVYKT- -EQGKTA-FFDANMKQEIFDGVFK- -VYR-KVTK  560
WP_019312892  487  SAEAFIINRMTNYDLYLPNQKVLPKHSLLYEKFTVYNELTKVYKT- -EQGKTA-FFDANMKQEIFDGVFK- -VYR-KVTK  560
WP_019313659  487  SAEAFIINRMTNYDLYLPNQKVLPKHSLLYEKFTVYNELTKVYKT- -EQGKTA-FFDANMKQEIFDGVFK- -VYR-KVTK  560
WP_019314093  487  SVEAFIINRMTNYDLYLPNQKVLPKHSLLYEKFTVYNELTKVYKT- -EQGKTA-FFDANMKQEIFDGVFK- -VYR-KVTK  560
WP_019315370  487  SAEAFIINRMTNYDLYLPNQKVLPKHSLLYEKFTVYNELTKVYKT- -EQGKTA-FFDANMKQEIFDGVFK- -VYR-KVTK  560
WP_019803776  487  SAEAFIINRMTNYDLYLPNQKVLPKHSLLYEKFTVYNELTKVYKT- -EQGKTA-FFDANMKQEIFDGVFK- -VYR-KVTK  560
WP_019805234  487  SAEAFIINRMTNYDLYLPNQKVLPKHSLLYEKFTVYNELTKVYKT- -EQGKTA-FFDANMKQEIFDGVFK- -VYR-KVTK  560
WP_024783594  487  SAEAFIINRMTNYDLYLPNQKVLPKHSLLYEKFTVYNELTKVYKT- -EQGKTA-FFDANMKQEIFDGVFK- -VYR-KVTK  560
WP_024784288  487  SAQAFIEHMTNNDLYLPNEKVLPKHSPLYEKFTVYNELTKVIKVT- -EIGEAK-FFDANLKQEIFDGLFK- -HER-KVTK  560
WP_024784666  487  SAEAFIINRMTNYDLYLPNQKVLPKHSLLYEKFTVYNELTKVYKT- -EQGKTA-FFDANMKQEIFDGVFK- -VYR-KVTK  560
WP_024784894  487  SAEAFIEHMTNNDLYLPNEKVLPKHSPLYEKFTVYNELTKIKVVT- -EIGEAK-FFDANLKQEIFDGLFK- -HER-KVTK  560
WP_024786433  487  SAQAFIEHMTNNDLYLPNEKVLPKHSPLYEKFTVYNELTKIKVVT- -EIGEAK-FFDANLKQEIFDGLFK- -HER-KVTK  560
WP_049473442  487  SAEAFIINRMTNYDLYLPNQKVLPKHSLLYEKFTVYNELTKVYKT- -EQGKTA-FFDANMKQEIFDGVFK- -VYR-KVTK  560
WP_049474547  487  SAEAFIINRMTNYDLYLPNQKVLPKHSLLYEKFTVYNELTKVYKT- -EQGKTA-FFDANMKQEIFDGVFK- -VYR-KVTK  560
EMC03581      480  SAESFINKMTNYDLYLPNQKVLPKHSLLYETFAVYNELTKVKFIA- -EGLRDYqFLDSRQKDIFYTLFKaeDKR-KVTE  553
WP_000428612  488  SAEDFIINKMTNYDLYLPEEKVLPKHSLLYETFAVYNELTKVKFIA- -EGLRDYqFLDSGQKKQIVTQLFK- -EKR-KVTE  564
WP_000428613  487  SAEDFIHRMTNKMTNYDLYLPEEKVLPKHSLLYETFAVYNELTKVKFIA- -EGMKDYqFLDSGQKKQIVTQLFK- -EKR-KVTE  562
WP_049522028  456  SAKVFIERMTNYDLYLPNFDTYLPEEKVLPKHSLLYETFAVYNELTKVKYQA- -EGMRKPeFLSSEEKIBIVSNLFK- -TER-KVTV  530
WP_003107102  488  SAQAFIERMTNKTNYDLYLPQEKVLPKHSLLYETFAVYNELTKVKVT- -EGMTKPeFLSAGQKEQIVELLFK- -KYR-KVTV  562
WP_054279288  489  SAEAFINKMTNYDLYLPNQKVLPKHSLLYETFAVYNELTKVKFIA- -EGLRDYqFLDSGQKKKIINQLFK- -EKR-KVTE  563
WP_049531101  488  SAEDFINKMTNYDLYLPEEKVLPKHSLLYETFAVYNELTKVKFIA- -EGLRDYqFLDSGQKKQIVNQLFK- -EKR-KVTE  562
WP_049538452  488  SAEDFINKMTNYDLYLPEEKVLPKHSLLYETFAVYNELTKVKFIA- -EGLRDYqFLDSGQKKQIVNQLFK- -EKR-KVTE  562
WP_049549711  490  SAQAFIEHMTNYDLYLPEEKVLPKHSPLYEMFTVYNELTKVKYIA- -ENMTKPlYLSAEQKEAIIDHLFK- -QTR-KVTV  564
WP_047896501  442  SAQAFIEGMTNYDLYLPEEKVLPKHSPLYEMFTVYNELTKVKYIA- -EGLRDYqFLDSGQKKQIVNQLFK- -EKR-KVTE  516
EFR44625      487  SAEDFIHRMTNKMTNYDLYLPEEKVLPKHSLLYETFAVYNELTKVKFIA- -EGLRDYqFLDSGQKKQIVNQLFK- -DKR-KVTE  561
WP_002897477  487  SAEDFINKMTNYDLYLPEEKVLPKHSLLYETFAVYNELTKVKFIA- -EGLRDYqFLDSGQKKQIVTQLFK- -EKR-KVTE  561
WP_002906454  488  SAEDFINKMTNYDLYLPEEKVLPKHSLLYETFAVYNELTKVKFIA- -EGLRDYqFLDSGQKAIVDLLFK- -KER-KVTE  562
WP_009729476  488  SAQAFIERMTNKMTNDLYLPDQKVLPKHSLLYQKFAVYNELTKVKIKVT- -ETGEAR-LFDVFLKKEIFDGLEK- -KER-KVTE  561
CQR24647      487  SAEDFINKMTNDLYLPDQKVLPKHSLLYEKFAVYNELTKVKFIA- -EGLTRYqFLDKKQKKDIFDTFFKaeNKR-KVTE  564
WP_000066813  488  SAESFINKMTNYDLYLPDQKVLPKHSLLYEKFAVYNELTKVKFIA- -EGLRDYqFFDSGQKKQIVNQLFK- -EKR-KVTE  562
WP_009754323  488  SAENFITRMTNYDLYLPDQKVLPKHSLLYETFTVYNELTKVKFIA- -EGMRDYqFLDSGQKKDIVKTLFK- -TKR-KVTA  562
WP_044676715  487  SAENFITRMTNYDLYLPDQKVLPKHSLLYETFTVYNELTKVRVT- -EQGKSF-FFDANMKQEIFDGVFK- -VYR-KVTK  561
WP_044680361  487  SAENFITRMTNYDLYLPDQKVLPKHSLLYEKFAVYNELTKVKFIA- -EGMRKPeFLSGEGQKAIVDLLFK- -TKR-KVTA  560
WP_044681799  487  SAENFITRMTNYDLYLPDQKVLPKHSLLYETFTVYNELTKVKFIA- -EGMRDYqFLDSGQKDIVKTLFK- -TKR-KVTA  561
WP_049533112  487  SAEKFITRMTLNDLYLPEEKVLPKHSLLYETFTVYNELTKVYVN- -EQGEAK-FFDANMKQEIFDHVEK- -ENR-KVTK  561
WP_029090905  472  SSEAFIKRMTNKCTYLIHEDVIPKHSFSYAKFEVLNELNKIRLDG- - - - - -KP- -IDIPLKKRIFEGLFL- -EKtKVTQ  540
WP_006506696  499  TAEGFIKRMRSYCTYFPDEEVLPKNSLIVSKYEVYNELNKIRVDD- - - - - - -kLLEVDVKNDIYNELFM- -KQNK-TVTE  567
AIT42264      487  SAQSFIERMTNEDKNLPNEKVLPKHSLLYEYFTVYNELTKVKVT- -EGMRKPaFLSGEQKAIVDLLFK- -TNR-KVTV  561
WP_034440723  494  SAELFIENLTSRDTYLPDEPVLPKHSRSLLYQTFIFNELTKISYID- -ERGILQ-NFSSREKIAIENDLEK- -NKsKVTK  567
AKQ21048      487  SAQSFIERMTNEDKNLPKHSFSYAKFEVLNELNKIRLDG- - - - - -KP- -IDIPLKKRIFEGLFL- -EKtKVTQ  561
WP_004636532  489  SABKFIERMTNMDTYLLEEKVLPSEKVLPKHSLLYQTFEVYNELTKVRTN- -EQGKTB-KLNRQQKABIIETLFK- -qKNR- -VRE  562
WP_002364836  496  SATAFIERMTNEDTYLPSEKVLPKHSLLYEKMVFNELMLTKISYTD- -DRGIKA-NFSGKEKEKIFDYLFK- -TRR-KVKK  569
WP_016631044  447  SATIAFIERMTNEDTYLPSEKVLPKHSLLYEKFMVFNELNLTKISYTD- -DRGIKA-NFSGKEKEKIFDYLFK- -TRR-KVKK  520
EMS75795      232  SAMKFIQRMINYDTYLPEKVLPKHSILYQKTFIFNELTKVAYKD- -ERGIKH-QESSKEKEREIFKELFQ- -KQR-KVTV  305
```

```
WP_002373311      496  SATAFIERMTNEDTYLPSEKVLPKHSLLYEKFMVFNELTKISYTD--DRGIKA-NFSGKEKEKIFDYLFK--TRR-KVKK  569
WP_002378009      496  SATAFIERMTNEDTYLPSEKVLPKHSLLYEKFMVFNELTKISYTD--DRGIKA-NFSGKEKEKIFDYLFK--TRR-KVKK  569
WP_002407324      496  SATAFIERMTNEDTYLPSEKVLPKHSLLYEKFMVFNELTKISYTD--DRGIKA-NFSGKEKEKIFDYLFK--TRR-KVKK  569
WP_002413717      498  SATAFIERMTNEDTYLPSEKVLPKHSLLYEKFMVFNELTKISYTD--DRGIKA-NFSGKEKEKIFDYLFK--TRR-KVKK  571
WP_010775580      496  SATAFIERMTNEDTYLPSEKVLPKHSLLYEKFMVFNELTKISYTD--DRGIKA-NFSGKEKEKIFDYLFK--TRR-KVKK  569
WP_010818269      496  SATAFIERMTNEDTYLPSEKVLPKHSLLYEKFMVFNELTKISYTD--DRGIKA-NFSGKEKEKIFDYLFK--TRR-KVKK  569
WP_010824395      496  SATAFIERMTNEDTYLPSEKVLPKHSLLYEKFMVFNELTKISYTD--DRGIKA-NFSGKEKEKIFDYLFK--TRR-KVKK  569
WP_016622645      496  SATAFIERMTNEDTYLPSEKVLPKHSLLYEKFMVFNELTKISYTD--DRGIKA-NFSGKEKEKIFDYLFK--TRR-KVKK  569
WP_033624816      496  SATAFIERMTNEDTYLPSEKVLPKHSLLYEKFMVFNELTKISYTD--DRGIKA-NFSGKEKEKIFDYLFK--TRR-KVKK  569
WP_033625576      496  SATAFIERMTNEDTYLPSEKVLPKHSLLYEKFMVFNELTKISYTD--DRGIKA-NFSGKEKEKIFDYLFK--TRR-KVKK  569
WP_033789179      496  SATAFIERMTNEDTYLPSEKVLPKHSLLYEKFMVFNELTKISYTD--DRGIKA-NFSGKEKEKIFDYLFK--TRR-KVKK  569
WP_002310644      493  SAVRFIERMINTDMYMPHNKVLPKNSLLYQKFSIYNELTKVRYQD--ERGQMN-YFSSIEKKEIFHELFE--KQNR-KVTK  566
WP_002112694      494  SAVRFIERMINTDMYMPHNKVLPKNSLLYQKFSIYNELTKVRYQD--ERGQMN-YFSSIEKKEIFHELFE--KQNR-KVTK  567
WP_002314015      494  SAVRFIERMINNTDMYIPHNKVLPKNSLLYQKFSIYNELTKVRYQD--ERGQMN-YFSSIEKKEIFHELFE--KQNR-KVTK  567
WP_002320716      494  SAVRFIERMINTDMYIPHNKVLPKNSLLYQKFSIYNELTKVRYQD--ERGQMN-YFSSIEKKEIFHELFE--KQNR-KVTK  567
WP_002330729      493  SAVRFIERMINTDMYIPHNKVLPKNSLLYQKFSIYNELTKVRYQD--ERGQMN-YFSSIEKKEIFHELFE--KQNR-KVTK  566
WP_002335161      494  SAVRFIERMINTDMYMPHNKVLPKNSLLYQKFSIYNELTKVRYQD--ERGQMN-YFSSIEKKEIFHELFE--KQNR-KVTK  567
WP_002345439      494  SAVRFIERMINTDMYIPHNKVLPKNSLLYQKMIFNELTKVSYKD--ERGVKQ-YFSGDEKQQIFKQLFQ--KERgKITV  567
WP_034867970      487  SAMRFIQRMTKQDTYLPTEKVLPKNSLLYQKMIFNELTKVSYKD--ERGVKQ-YFSGDEKQQIFKQLFQ--KERgKITV  561
WP_047937432      494  SAVRFIERMINTDMYMPHNKVLPKNSLLYQKMIFNELTKVSYKD--ERGQMN-YFSSIEKKEIFHELFE--KQNR-KVTK  567
WP_010720994      487  SAMRFIQRMTKQDTYLPTEKVLPKNSLPYQKYMIFNELTKVSYKD--ERGVKQ-YFSGDEKQQIFKQLFQ--KERgKITV  561
WP_010737004      487  SAMRFIQRMTKQDTYLPTEKVLPKNSLLYQKMIFNELTKVSYKD--ERGVKQ-YFSGDEKQQIFKQLFQ--KERgKITV  561
WP_034700478      491  SAVRFIERMTIKDIYL-NENVLPRHSLIYEKFTVFNELTKVLAD--DRGVFQ-RFSAEEKEDIFEKLFK--SER-KVTK  563
WP_007209003      486  SAIEFIERMTNQDTYLPENVLPKHSLIYQRFMIFNELTKVSYTD--ERGKSH-YFSSEQKRKIFNELFK--QHP-RVTE  559
WP_023519017      490  SATKFIERMTNEDTYLPTEKVLPKHSMIYEKMYVNELTKVSYVD--ERGMNQ-RFSGEEKKQIVEELFK--QSR-KVTK  563
WP_010777040      486  SAELFIERMIYVTFDLYLPSEKVLPKHSMLYQKYTIFNELTKVAYKD--EQGKVQ-NFSSEEKERIFIDLFK--QHR-RVTK  559
WP_048604708      487  SATKFIQRMINYDTYLPTEKVLPKYSMLYQKYTIFNELTKVAYKD--DRGIKH-QFSSEEKLRIFQELFK--KQR-KVTK  560
WP_010750235      526  SAQSFIERMTNEDTYLPTEKVLPNEKVLNEKVLPKHSLLYEYFTVYNELTKVKVT-BGMRKPaFLSGEQKKAIVDLLFK--TNR-KVTV  600
AII16583          507  TADEFIKRMRNFCTYFPDEPVLAKNSLTVSKYEVLNEINKLRIND------hLIKRDIKDKMLHTLFM--DHK-SISA  575
WP_029073316      507  TADEFIKRMRNFCTYFPDEPVMAKNSLTVSKYEVLNEINKLRIND------hLIKRDMKDKMLHTLFM--DHK-SISA  575
WP_031589969      485  SAEDFIKRMTINDLYLPTEPVLPKHSLLYERTFINELAGVRVT-ENGEAK-YFDAQTKRSIFE-LFK1--DR-KVSE  557
KDA45870          510  SANEFIKRMTTTDTYLLAEDVLPKQSLIYQRFEVLNELNGLKIDD-QPITTE----LKQAIFTDFM-QKtSVTV  578
WP_039099354      484  SSNKFIERMTVDSYLVGEPVLPKENVLPKHSLCYQKYLVYNELTKVRYIN--EnIKTNPTGSRLTVETKQHIYNELFK--NYK-KITV  560
AKP02966          493  SAVDFIEKMTNKDTYLPKENVLPKHSLCYQKYLVYNELTKVRYIN--DQGKTS-YFSGQEKEQIFNDLFK--QKR-KVKK  566
WP_010991369      493  SAVDFIEKMTNKDTYLPKENVLPKHSLCYQKYLVYNELTKVRYIN--DQGKTS-YFSGQEKEQIFNDLFK--QKR-KVKK  566
WP_033838504      496  SAVDFIEKMTNKDTYLPKENVLPKHSLCYQKYLVYNELTKVRYIN--DQGKTS-YFSGQEKEQIFNDLFK--QKR-KVKK  569
EHN60060          262  SAVDFIEKMTNKDTYLPKENVLPKHSLCYQKYLVYNELTKVRYIN--DQGKTS-YFSGQEKEQIFNDLFK--QKR-KVKK  335
EFR89594          493  SAIDFIEKMTNKDTYLPKENVLPKHSLCYQKYMVYNELTKIRYID--DQGKTH-HFSGQEKQQIFNGLFK--QQR-KVKK  566
WP_038409211      112  SAIDFIEKMTNKDTYLPKENVLPKHSLCYQKYMVYNELTKIRYID--DQGKTH-HFSGQEKQQIFNGLFK--QQR-KVKK  185
EFR95520          493  SAVDFIEKMTNKDTYLPKENVLPKHSLCYQKYMVYNELTKIRYID--DQGKTN-YFSGREKQQVFNDLFK--QKR-KVKK  566
WP_003723650      493  SAVDFIEKMTNKDTYLPKENVLPKHSLCYQKYMVYNELTKIRYID--DQGKTN-YFSGREKQQVFNDLFK--QKR-KVKK  566
WP_003727705      493  SAVDFIEKMTNKDTYLPKENVLPKHSLCYQKYMVYNELTKIRYID--DQGKTN-YFSGREKQQIFNDLFK--QKR-KVKK  566
WP_003730785      493  SAVDFIEKMTNKDTYLPKENVLPKHSLCYQKYMVYNELTKIRYID--DQGKTN-YFSGREKQQIFNDYFK--QKR-KVSK  566
WP_003733029      493  SAVDFIEKMTNKDTYLPKENVLPKHSLCYQKYMVYNELTKVRYID--DQGKTN-YFSGEKQQIFNDLFK--QKR-KVKK  566
WP_003739838      493  SAVDFIEKMTNKDTYLPKENVLPKHSLCYQKYMVYNELTKVRYID--DQGKTN-YFSGEKQQIFNDLFK--QKR-KVKK  566
WP_014601172      493  SAVDFIEKMTNKDTYLPKENVLPKHSLCYQKYMVYNELTKVRYID--DQGKTN-YFSGEKQQIFNDLFK--QKR-KVKK  566
WP_023548323      493  SAVDFIEKMTNKDTYLPKENVLPKHSLCYQKYMVYNELTKVRYID--DQGKTN-YFSGEKQQIFNDLFK--QKR-KVKK  566
WP_031665337      493  SAVDFIEKMTNKDTYLPKENVLPKHSLCYQKYMVYNELTKVRYID--DQGKTN-YFSGEKQQIFNDLFK--QKR-KVKK  566
WP_031669209      493  SAVDFIEKMTNKDTYLPKENVLPKHSLCYQKYMVYNELTKVRYID--DQGKTN-YFSGEKQQIFNDLFK--QKR-KVKK  566
WP_033920898      493  SAVDFIEKMTNKDTYLPKENVLPKHSLCYQKYMVYNELTKVRYID--DQGKTN-YFSGEKQQIFNDLFK--QKR-KVKK  566
AKI42028          496  SAVDFIEKMTNKDTYLPKENVLPKHSLCYQKYMVYNELTKVRYID--DQGKTN-YFSGEKQQIFNDLFK--QKR-KVKK  569
AKI50529            1  ------------------------------------------------------------IFNDLFK--QKR-KVKK   14
EFR83390            1  --------------------------------------------------------------------------------   
```

```
-continued

WP_046323366  493  SAIDFIEKMTNKDTYLPKENVLPKHSMCYQKYMVYNELTKIRYTD--DQGKTH-YFSGQEKQQIFNDLFK--QKR-KVKK       566
AKE81011      503  SAQSFIERMTNFDKNLPNEKVLPKHSLLYEYFTVYNELTKVKYVT--EGMRKPaFLSGEQKKAIVDLLFK--TNR-KVTV       577
CU082355      503  TAEGFIKRMRSYCTYFPDEEVLPKNSLIVSKYEVYNELNKIRVDD----kLLEVDVKNDIYNELFM--KNK-TVTE         571
WP_033162887  504  TAEGFIERMKNTGTYFPDEPVMAKNSLTVSKFEVLNELNKIRING------kLIAVETKKELLSDLFM--KNK-TITD      572
AGZ01981      520  SAQSFIERMTNFDKNLPNEKVLPKHSLLYEYFTVYNELTKVKYVT--EGMRKPaFLSGEQKKAIVDLLFK--TNR-KVTV       594
AKA60242      487  SAQSFIERMTNFDKNLPNEKVLPKHSLLYEYFTVYNELTKVKYVT--EGMRKPaFLSGEQKKAIVDLLFK--TNR-KVTV       561
AKS40380      487  SAQSFIERMTNFDKNLPNEKVLPKHSLLYEYFTVYNELTKVKYVT--EGMRKPaFLSGEQKKAIVDLLFK--TNR-KVTV       561
4UN5_B        491  SAQSFIERMTNFDKNLPNEKVLPKHSLLYEYFTVYNELTKVKYVT--EGMRKPaFLSGEQKKAIVDLLFK--TNR-KVTV       565
WP_010922251  562  KQLKEDYFKK--IECFDSVEISGVEDR----FNASLGTYHDLLKIIKDK                DFLDNEENEDILEDIVLTLTLFEDREMIE  633
WP_039695303  564  EKLLNYLNKE--FPEYRIKDLIGLDKEhkSFNASLGTYHDLLKKIL-DK              AFLDDKVNEEVIEDIIKTLTLFEDKDMIH  637
WP_045635197  562  KDIIHYLHN---VDGYDGIELKGIEKQ----FNASLSTYHDLLKIIKDK               EFMDDAKNEALENIVHTLTIFEDREMIK  632
5AXW_A        300  KQIAKEIVNe--EDIKGYRVTSTGKPe----FTNLKVHDIKDITARK                ------ENAELDQIAKILTIYQSSEDIQ  368
WP_009880683  246  KQLKEDYFKK--IECFDSVEISGVEDR----FNTSLGTYHDLLKIIKDK               DFLDNEENEDILEDIVLTLTLFEDREMIE  317
WP_010922251  562  KQLKEDYFKK--IECFDSVEISGVEDR----FNASLGTYHDLLKIIKDK               DFLDNEENEDILEDIVLTLTLFEDREMIE  633
WP_011054416  562  KQLKEDYFKK--IECFDSVEISGVEDR----FNASLGTYHDLLKIIKDK               DFLDNEENEDILEDIVLTLTLFEDREMIE  633
WP_011284745  562  KQLKEDYFKK--IECFDSVEISGVEDR----FNASLGTYHDLLKIIKDK               DFLDNEENEDILEDIVLTLTLFEDREMIE  633
WP_011285506  562  KQLKEDYFKK--IECFDSVEISGVEDR----FNASLGTYHDLLKIIKDK               DFLDNEENEDILEDIVLTLTLFEDREMIE  633
WP_011527619  562  KQLKEDYFKK--IECFDSVEISGVEDR----FNASLGTYHDLLKIIKDK               DFLDNEENEDILEDIVLTLTLFEDREMIE  633
WP_012560673  562  KQLKEDYFKK--IECFDSVEISGVEDR----FNASLGTYHDLLKIIKDK               DFLDNEENEDILEDIVLTLTLFEDREMIE  633
WP_014407541  562  KQLKEDYFKK--IECFDSVEISGVEDR----FNASLGAYHDLLKIIKDK               DFLDNEENEDILEDIVLTLTLFEDRGMIE  633
WP_020905136  562  KQLKEDYFKK--IECFDSVEISGVEDR----FNTSLGTYHDLLKIIKDK               DFLDNEENEDILEDIVLTLTLFEDKEMIE  633
WP_023080005  562  KQLKEDYFKK--IECFDSVEISGVEDR----FNASLGTYHDLLKIIKDK               DFLDNEENEDILEDIVLTLTLFEDKEMIE  633
WP_023610282  562  KQLKEDYFKK--IECFDSVEISGVEDR----FNASLGTYHDLLKIIKDK               DFLDNEENEDILEDIVLTLTLFEDREMIE  633
WP_030125963  562  KQLKEDYFKK--IECFDSVEISGVEDR----FNASLGTYHDLLKIIKDK               DFLDNEENEDILEDIVLTLTLFEDREMIE  633
WP_030126706  562  KQLKEDYFKK--IECFDSVEISGVEDR----FNASLGTYHDLLKIIKDK               DFLDNEENEDILEDIVLTLTLFEDREMIE  633
WP_031488318  562  KQLKEDYFKK--IECFDSVEISGVEDR----FNASLGTYHDLLKIIKDK               DFLDNEENEDILEDIVLTLTLFEDREMIE  633
WP_032460140  562  KQLKEDYFKK--IECFDSVEISGVEDR----FNASLGTYHDLLKIIKDK               DFLDNEENEDILEDIVLTLTLFEDREMIE  633
WP_032461047  562  KQLKEDYFKK--IECFDSVEISGVEDR----FNASLGTYHDLLKIIKDK               DFLDNEENEDILEDIVLTLTLFEDREMIE  633
WP_032462016  562  KQLKEDYFKK--IECFDSVEISGVEDR----FNASLGTYHDLLKIIKDK               DFLDNEENEDILEDIVLTLTLFEDREMIE  633
WP_032462936  562  KQLKEDYFKK--IECFDSVEISGVEDR----FNASLGTYHDLLKIIKDK               DFLDNEENEDILEDIVLTLTLFEDKEMIE  633
WP_032464890  562  KQLKEDYFKK--IECFDSVEISGVEDR----FNASLGTYHDLLKIIKDK               DFLDNEENEDILEDIVLTLTLFEDREMIE  633
WP_033888930  387  KQLKEDYFKK--IECFDSVEISGVEDR----FNASLGTYHDLLKIIKDK               DFLDNEENEDILEDIVLTLTLFEDKEMIE  458
WP_038431314  562  KQLKEDYFKK--IECFDSVEISGVEDR----FNASLGTYHDLLKIIKDK               DFLDNEENEDILEDIVLTLTLFEDREMIE  633
WP_038432938  562  KQLKEDYFKK--IECFDSVEISGVEDR----FNTSLGTYHDLLKIIKDK               DFLDNEENEDILEDIVLTLTLFEDKEMIE  633
WP_038434062  562  KQLKEDYFKK--IECFDSVEISGVEDR----FNASLGTYHDLLKIIKDK               DFLDNEENEDILEDIVLTLTLFEDREMIE  633
BAQ51233      473  ----------------------------------------------------           -------------------------------  544
KGE60162
KGE60856
WP_002989955  562  KKLLDFLAKE--YEEFRIVDVIGLDKEhkAFNASLGTYHDLEKIL-DK              DFLDNEENEDILEDIVLTLTLFEDREMIE  633
WP_003030002  561  DKLLNYLNKE--FEEFRIVNLTGLDKEhkAFNSSLGTYHDLRKIL-DK              SFLDDKANEKTIEDIIQTLTLFEDREMIR  634
WP_003065552  564  EKLLNYLNKE--FPEYRIKDLIGLDKEhkAFNASLGTYHDLEKIL-DK              AFLDDKVNEEVIEDIIKTLTLFEDKDMIH  637
WP_001040076  563  KDIISFLNK---VDGYEGIAIKGIEKQ----FNASLSTVHDLKKIL-GK              DFLDNTDNELILEDIVQTLTLFEDREMIK  632
WP_001040078  562  KKLLDFLAKE--YEEFRIVDVIGLDKEhkAFNASLGTYHDLEKIL-DK              DFLDNPDNESILEDIVQTLTLFEDREMIK  635
WP_001040080  562  KKLLDFLAKE--YEEFRIVDVIGLDKEhkAFNASLGTYHDLEKIL-DK              DFLDNPDNESILEDIVQTLTLFEDREMIK  635
WP_001040081  562  KKLLDFLAKE--YEEFRIVDVIGLDKEhkAFNASLGTYHDLEKIL-DK              DFLDNPDNESILEDIVQTLTLFEDREMIK  635
WP_001040083  562  KKLLDFLAKE--YEEFRIVDVIGLDKEhkAFNASLGTYHDLEKIL-DK              DFLDNPDNESILEDIIQTLTLFEDREMIK  635
WP_001040085  562  KKLLDFLAKE--YEEFRIVDVIGLDKEhkAFNASLGTYHDLEKIL-DK              DFLDNPDNESILEDIVQTLTLFEDREMIK  635
WP_001040087  562  KKLLDFLAKE--YEEFRIVDVIGLDKEhkAFNASLGTYHDLEKIL-DK              DFLDNPDNESILEDIVQTLTLFEDREMIK  635
WP_001040088  562  KKLLDFLAKE--YEEFRIVDVIGLDKEhkAFNASLGTYHDLEKIL-DK              DFLDNPDNESILEDIVQTLTLFEDREMIK  635
WP_001040089  562  KKLLDFLAKE--YEEFRIVDVIGLDKEhkAFNASLGTYHDLEKIL-DK              DFLDNPDNESILEDIVQTLTLFEDREMIK  635
WP_001040090  562  KKLLDFLAKE--YEEFRIVDVIGLDKEhkAFNASLGTYHDLEKIL-DK              DFLDNPDNESILEDIVQTLTLFEDREMIK  635
WP_001040091  562  KKLLDFLAKE--YEEFRIVDVIGLDKEhkAFNASLGTYHDLEKIL-DK              DFLDNPDNESILEDIVQTLTLFEDREMIK  635
WP_001040092  562  KQLLDFLAKE--FEEFRIVDVTGLDKEhkAFNASLGTYHDLEKIL-DK              DFLDNPDNESILEDIVQTITLFEDREMIK  635
```

-continued

| | | | | |
|---|---|---|---|---|
| WP_001040094 | 563 | KDIISFLNK---VDGYEGIAIKGIEKQ---FNASLSTYHDLKKKIL-GK | DFLDNTDNELIEDIVQTLTLFEDREMIR | 632 |
| WP_001040095 | 563 | KDIISFLNK---VDGYEGIAIKGIEKQ---FNASLSTYHDLKKKIL-GK | DFLDNTDNELIEDIVQTLTLFEDREMIR | 632 |
| WP_001040096 | 563 | KDIISFLNK---VDGYEGIAIKGIEKQ---FNASLSTYHDLKKKIL-GK | DFLDNTDNELIEDIVQTLTLFEDREMIR | 632 |
| WP_001040097 | 563 | KDIISFLNK---VDGYEGIAIKGIEKQ---FNASLSTYHDLKKKIL-GK | DFLDNTDNELIEDIVQTLTLFEDREMIR | 632 |
| WP_001040098 | 563 | KDIISFLNK---VDGYEGIAIKGIEKQ---FNASLSTYHDLKKKIL-GK | DFLDNTDNELIEDIVQTLTLFEDREMIR | 632 |
| WP_001040099 | 563 | KDIISFLNK---VDGYEGIAIKGIEKQ---FNASLSTYHDLKKKIL-GK | DFLDNTDNELIEDIVQTLTLFEDREMIR | 632 |
| WP_001040100 | 563 | KDIISFLNK---VDGYEGIAIKGIEKQ---FNASLSTYHDLKKKIL-GK | DFLDNTDNELIEDIVQTLTLFEDREMIR | 632 |
| WP_001040104 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040105 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040106 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040107 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040108 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040109 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_001040110 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_015058523 | 562 | KQLLDFLAKE-FEEFRIVDVTGLDKEhkAFNASLGTYHDLKKKIL-GK | DFLDNPDNESILEDIVQITLFEDREMIR | 635 |
| WP_001043650 | 563 | KDIISFLNK---VDGYEGIAIKGIEKQ---FNASLSTYHDLKKKIL-GK | DFLDNTDNELIEDIVQTLTLFEDREMIR | 632 |
| WP_017647151 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_017648376 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_017649527 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_017771611 | 562 | KKLLDFLAKE-YEEFRIVDVIGLDKEhkAFNASLGTYHDLKKKIL-DK | DFLDNPDNESILEDIVQTLTLFEDREMIK | 635 |
| WP_017771984 | 562 | KKLLDFLAKE-YEEFRIVDVIGLDKEhkAFNASLGTYHDLKKKIL-DK | DFLDNPDNESILEDIVQTLTLFEDREMIK | 635 |
| CFQ25032 | 562 | KKLLDFLAKE-YEEFRIVDVIGLDKEhkAFNASLGTYHDLEKKIL-DK | DFLDNPDNESILEDIVQTLTLFEDREMIK | 635 |
| CFV16040 | 562 | KKLLDFLAKE-YEEFRIVDVIGLDKEhkAFNASLGTYHDLKKKIL-DK | DFLDNPDNESILEDIVQTLTLFEDREMIK | 635 |
| KLJ37842 | 562 | KKLLDFLAKE-YEEFRIVDVIGLDKEhkAFNASLGTYHDLKKKIL-DK | DFLDNPDNESILEDIVQTLTLFEDREMIK | 635 |
| KLJ72361 | 562 | KKLLDFLAKE-YEEFRIVDVIGLDKEhkAFNASLGTYHDLKKKIL-DK | DFLDNPDNESILEDIVQTLTLFEDREMIK | 635 |
| KLL20707 | 562 | KKLLDFLAKE-YEEFRIVDVIGLDKEhkAFNASLGTYHDLKKKIL-DK | DFLDNPDNESILEDIVQTLTLFEDREMIK | 635 |
| KLL42645 | 563 | KDIISFLNK---VDGYEGIAIKGIEKQ---FNASLSTYHDLKKKIL-GK | DFLDNTDNELIEDIVQTLTLFEDREMIR | 632 |
| WP_047202273 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_047209694 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_050198062 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_050201642 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_050204027 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_050881965 | 562 | KKLLDFLAKE-YEEFRIVDVIGLDKEhkAFNASLGTYHDLEKKIL-DK | DFLDNPDNESILEDIVQTLTLFEDREMIK | 635 |
| WP_050886065 | 562 | KKLLDFLAKE-YEEFRIVDVIGLDKEhkAFNASLGTYHDLEKKIL-DK | DFLDNPDNESILEDIVQTLTLFEDREMIK | 635 |
| AHN30376 | 562 | KQLLDFLAKE-FEEFRIVDVTGLDKEhkAFNASLGTYHDLEKKIL-GK | DFLDNPDNESILEDIVQTLTLFEDREMIR | 635 |
| EAO78426 | 561 | DKLLNYLNKE-FEEFRIVNLTGLDKEhkVENNSLGTYHDLRKKIL-NK | SFLDNKENAQIIEDIQTLTLFEDREMIR | 634 |
| CCW42055 | 562 | KKLLDFLAKE-FEEFRIVDVDTGLDKEhkAFNASLGTYHDLEKKIL-GK | DFLDNPDNESILEDIVQTLTLFEDREMIK | 635 |
| WP_003041502 | 561 | DKLLNYLNKE-FEEFRIVNLTGLDKEhkAENSSLGTYHDLRKKIL-DK | SFLDDKANEKTIEDIIQTLTLFEDREMIR | 635 |
| WP_037593752 | 562 | DKLLNYLNKE-FEEFRIVNLTGLDKEhkAENSSLGTYHDLRKKIL-DK | SFLDDKANEKTIEDIIQTLTLFEDREMIR | 635 |
| WP_049516684 | 561 | DKLLNYLNKE-FEEFRIVNLTGLDKEhkAENSSLGTYHDLRKKIL-DK | SFLDDKVNEKIEDIIQTLTLFEDREMIR | 634 |
| GAD46167 | 561 | DKLLNYLNKE-FEEFRIVNLTGLDKEhkAENSSLGTYHDLRKKIL-DK | SFLDDKANEKTIEDIIQTLTLFEDREMIR | 634 |
| WP_018363470 | 562 | EKLLNYLNKE-PPEYRIQDLVGLDKEhkSFNASLGTYHDLKKKIL-DK | SFLDDKVNEEVIEDIIKTLTLFEDREMIR | 635 |
| WP_003043819 | 572 | KQLKEDYPKK-IECEDSVEIIGVEDR---FNASLGTYHDLLKIIKDK | DFLDNEENEDILEDIVLTLTLTLFEDKEMIE | 643 |
| WP_062669658 | 561 | DKLLNYLNKE-FEEFRIVNLTGLDKEhkAENSSLGTYHDLRKKIL-DK | SFLDDKANEKTIEDIIQTLTLFEDREMIR | 634 |
| WP_048800889 | 561 | DKLLNYLDKE-PDEFRIVDLTGLDKEhkAFNASLGTYHDLRKKIL-DK | SFLDDKANEKTIEDIIQTLTLFEDREMIR | 634 |
| WP_012767106 | 562 | KQLKEDYPKK-IECEDSVEIIGVEDR---FNASLGTYHDLLKIIKDK | DFLDNEENEDILEDIVLTLTLFEDKEMIE | 635 |
| WP_014612333 | 562 | KQLKEDYPKK-IECEDSVEISGVEDR---FNASLGTYHDLLKIIKDK | DFLDNEENEDILEDIVLTLTLFEDKEMIE | 633 |
| WP_015017095 | 562 | KQLKEDYPKK-IECEDSVEISGVEDR---FNASLGTYHDLLKIIKDK | DFLDNEENEDILEDIVLTLTLFEDKEMIE | 633 |
| WP_015057649 | 562 | KQLKEDYPKK-IECEDSVEISGVEDR---FNASLGTYHDLLKIIKDK | DFLDNEENEDILEDIVLTLTLFEDKEMIE | 633 |
| WP_048277215 | 562 | KQLKEDYPKK-IECEDSVEISGVEDS---FNASLGTYHDLLKIIKDK | DFLDNEENEDILEDIVLTLTLFEDKEMIE | 633 |
| WP_049519324 | 562 | KQLKENYFKK-IECEDSVEITGVEDS---FNASLGTYHDLLKIIKDK | DFLDNPDNQKIIEDIILTLTLFEDKKMIS | 633 |
| WP_012515931 | 562 | KQLKENYFKK-IECWDSVEITGVEDS---FNASLGTYHDLLKIIQDK | DFLDNPDNQKIIEDIILTLTLFEDKKMIS | 633 |
| WP_021320964 | 562 | KQLKENYFKK-IECWDSVEITGVEDS---FNASLGTYHDLLKIIQDK | DFLDNPDNQKIIEDIILTLTLFEDKKMIS | 633 |

-continued

| | | | | |
|---|---|---|---|---|
| WP_037581760 | 562 | KQLKENYPKK- | -IECWDSVEITGVEDS---FNASLGTYHDLLKIIQDK | DFLDNPDNQKILEDILLTLTLFEDKKMIS | 633 |
| WP_044232481 | 561 | AKLLSYLNNE- | -FEEFRINDLIGLDKDskSFNASLGTYHDLKKIL-DK | SFLDDKTNEQIIEDIVLTLTLFEDKDMIH | 634 |
| WP_009854540 | 562 | EKLLNYLNKE- | -FPEYRIKDLIGLDKEnkSFNASLGTYHDLKKIL-DK | AFLDDKVNEEVIEDIIKTLTLFEDKDMIH | 635 |
| WP_012962174 | 562 | DKFLNYLNKE- | -FPEYRIQDLIGLDKEhkSFNASLGTYHDLKKIL-DK | SFLDDKTNETIIEDIIQTLTLFEDRDMIH | 637 |
| WP_039695303 | 564 | EKLLNYLNKE- | -FPEYRIKDLIGLDKEnkSFNASLGTYHDLKKIL-DK | AFLDDKVNEEVIEDIIKTLTLFEDKDMIH | 634 |
| WP_014334983 | 561 | AKLLSYLNNE- | -FEEFRINDLIGLDKDskSFNASLGTYHDLKKIL-DK | SFLDDKTNGQIIEDIVLTLTLFEDRDMIH | 633 |
| WP_003099269 | 562 | KQLKEEYESK- | -MKCFHTVTILGVEDR---FNASLGTYHDLLKIFKDK | AFLDDEANQDILEEIVWTLTLFEDQAMIE | 633 |
| AHY15608 | 562 | KQLKEEYESK- | -MKCFHTVTILGVEDR---FNASLGTYHDLLKIFKDK | AFLDDEANQDILEEIVWTLTLFEDQAMIE | 633 |
| AHY17476 | 562 | KQLKEEYESK- | -MKCFHTVTILGVEDR---FNASLGTYHDLLKIFKDK | AFLDDEANQDILEEIVWTLTLFEDQAMIE | 633 |
| ESR09100 | | ---------- | ----------------------------------- | ---------------------------- | |
| AGM98575 | 562 | KQLKEEYESK- | -MKCFHTVTILGVEDR---FNASLGTYHDLLKIFKDK | AFLDDEANQDILEEIVTLTLFEDQAMIE | 633 |
| ALF27331 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_018372492 | 574 | RKLKDFIEKElgYGYIDIDNIKGVEEBQ--- | FNASYTTYQDLLKIIGDK | EFLDNEENKDLLEEIYILTVFEDREKMIE | 647 |
| WP_045618028 | 563 | KDIIQYLHN-- | -VDSYDGIELKGIEKQ---FNASLSTYHDLLKIIKDK | EFMDDSKNEAILENIVHTLTIFEDREMIK | 633 |
| WP_045635197 | 562 | KDIIHYLHN-- | -VDGYDGIELKGIEKQ---FNASLSTYHDLLKIIKDK | EFMDDAKNEAILENIVHTLTIFEDREMIK | 632 |
| WP_002263549 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002263887 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002264920 | 561 | DKLMDFLEKE- | -FDEFRIVDLTGLDKEhkAFNASYGTYHDLRKIL-DK | VFMDNPENAELENIVLTLTLFEDREMIK | 635 |
| WP_002269043 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002269448 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002271977 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002272766 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002273241 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002275430 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002276448 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002277050 | 561 | DKLMDFLEKE- | -FDEFRIVDIQGLDKEteTFNASYATYQDLLKVIKDK | DFLDNSKNEKILEDIVLTLTLFEDREMIK | 635 |
| WP_002773364 | 561 | KKLRTFLDKN- | -FDEFRIVDLTGLDKEhkAFNASYGTYHDLRKIL-DK | DFLDNSKNEKILEDIVLTLTLFEDREMIR | 634 |
| WP_002279025 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002279859 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002280230 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002281696 | 561 | DKLMDFLEKE- | -FDEFRIVDLIQGLDKEteTFNASYATYQDLLKVIKDK | VFMDNPENAELENIVLTLTLFEDREMIR | 635 |
| WP_002282247 | 561 | KKLRTFLDKN- | -FDEFRIVDLTGLDKEhkVFNASYGTYHDLCKIL-DK | DFLDNSKNEKILEDIVLTLTLFEDREMIR | 634 |
| WP_002282906 | 561 | DKLMDFLEKE- | -FDEFRIVNLTGLDKEhkVENSSLGTYHDLRKIL-DK | SFLDNENEQIIEDIIQLTLTLFEDREMIR | 635 |
| WP_002283846 | 571 | DKLLNYLNKE- | -FEEFRIVDLTGLDKEhkAFNASYGTYHDLRKIL-NK | DFLDNSKNEKILEDIVLTLTLFEDREMIR | 644 |
| WP_002287255 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002288990 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002289641 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002290427 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002295753 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_002296423 | 561 | DKLMDFLEKE- | -FDEFRIVDLTGLDKEhkVFNASYGTYHDLRKIL-DK | DFLDNSKNEKILEDIVLTLTLFEDREMIR | 634 |
| WP_002304487 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_002305844 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_003072203 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_003310390 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_023352408 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_012997688 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_014677909 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_019312892 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_019313659 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_019314093 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_019315370 | 561 | DKLMDFLEKE- | -FDEFRIVDLTGLDKEhkVFNASYGTYHDLCKIL-DK | DFLDNSKNEKILEDIVLTLTLFEDREMIR | 634 |
| WP_019803776 | 561 | DKLMDFLEKE- | -FDEFRIVDLTGLDKEhkAFNASYGTYHDLRKIL-DK | DFLDNSKNEKILEDIVLTLTLFEDREMIR | 634 |
| WP_019805234 | 561 | DKLMDFLEKE- | -FDEFRIVDLTGLDKEhkAFNASYGTYHDLRKIL-DK | DFLDNSKNEKILEDIVLTLTLFEDREMIR | 634 |

```
WP_024783594  561 DKLMDFLEKE--FDEFRIVDLTGLDKEnkVFNASYGTYHDLCKIL-DK  DFLDNSKNEKILEDIVLTLTLFEDREMIR  634
WP_024784288  561 KKLRTFLDKN--FDEFRIVDIQGLDKEteTFNASYATYQDLLKVIKDK  VFMDNPENAEILENIVLTLTLFEDREMIK  635
WP_024784666  561 DKLMDFLEKE--FDEFRIVDLTGLDKEnkAFNASYGTYHDLRKIL-DK  DFLDNSKNEKILEDIVLTLTLFEDREMIR  634
WP_024784894  561 DKLMDFLEKE--FDEFRIVDLTGLDKEnkVFNASYGTYHDLCKIL-DK  DFLDNSKNEKILEDIVLTLTLFEDREMIR  635
WP_024786433  561 KKLRTFLDKN--FDEFRIVDIQGLDKEteTFNASYATYQDLLKVIKDK  VFMDNPENAEILENIVLTLTLFEDREMIK  634
WP_049473442  561 DKLMDFLEKE--FDEFRIVDLTGLDKEnkVFNASYGTYHDLCKIL-DK  DFLDNSKNEKILEDIVLTLTLFEDREMIR  634
WP_049474547  561 DKLMDFLEKE--FDEFRIVDLTGLDKEnkAFNASYGTYHDLRKIL-DK  DFLDNSKNEKILEDIVLTLTLFEDREMIR  634
EMC03581      554 DKLMDFLEKE--FDEFRIVDLTGLDKEnkVFNASYGTYHDLCKIL-DK  DFLDNSKNEKILEDIVLTLTLFEDREMIR  627
WP_000428612  565 KDIIQYLHT---VDGYDGIELKGIEKQ---FNASLSTYHDLLKIIKDK  EFMDDPNNEEILENIVHTLTIFEDREMIK  635
WP_000428813  563 KDIIQFLHN---VDGYDGIELKGIEKQ---FNASLSTYHDLLKIIKDK  EFMDDSKNEEILENIVHTLTIFEDREMIK  633
WP_049523028  562 KDIIHYLHN---VDGYDGIELKGIEKH---FNSSLSTYHDLLKIIKDK  EFMDDPKNEEIFENIVHTLTIFEDREMIK  632
WP_003107102  531 KQLKENYPNK--IRCLDSITISGVEDK---FNASLGTYHDLLNIIKNQ  KILDDEQNQDSLEDIVLTLTLFEDRVMIK  602
WP_054279288  564 KQLKEDFFSK--IECFDTVDISGVEDR---FNASLGTYHDLLKIIKDK  AFLDNSENENIIEDILLTLTLFEDKEMIA  635
WP_049531101  563 KDLIHYLHN---VDGYDGIELKGIEKQ---FNASLSTYHDLLKIIKDK  RFMDEPKNQEILENIVHTLTIFEDREMIK  633
WP_049538452  563 KDIIQYLHN---VDGYDGIELKGIEKQ---FNASLSTYHDLLKIIKDK  EFMDDSKNEEILENIVHTLTIFEDREMIK  633
WP_049549711  563 KDIIHYLHT---VDGYDGIELKGIEKQ---FNASLSTYHDLLKIIKDK  EFMDDSKNEAILENIVHTLTIFEDREMIK  633
WP_007896501  565 KDLKEKYPSQ--IEGLENVDVTGVEGA---FNASLGTYNDLLKIIKDK  AFLDDEANAEILEEIVLLILTLFQDEKLIE  636
EFR44625      517 KDLKEKYPSQ--IEGLENVDVTGVEGA---FNANLSTYHDLLKITKDK  AFLDDEANAEILEEIVLILTLFQDEKLIE  588
WP_002897477  562 KDIIHYLHN---VDGYDGIELKGIEKQ---FNASLSTYHDLLKIIKDK  EFMDDPKNEEILENIVHTLTIFEDREMIK  632
WP_002906454  562 KDIIHYLHN---VDGYDGIELKGIEKQ---FNASLSTYHDLLKIIKDK  EFMDNPKNGEILENIIHTLTIFEDREMIK  632
WP_009729476  563 KDIIQFLHN---VDGYDGIELKGIEKQ---FNASLSTYHDLLKIIKDK  AFMDDAKNEAILENIVHTLTIFEDREMIK  633
CQR24647      562 KKILNELDKN--FDEFRITDIQSLDNEtgNENASYGTYHDLLKIIGDK  EFMDSSDNVDVLEDIVLSLTLFEDREMIK  636
WP_000068813  565 KDIIHYLHN---VDGYDGIELKGIEKQ---FNASLSTYHDLLKIIKDK  AFMDDSKNEEILENIIHTLTIFEDREMIK  635
WP_009754323  563 KDIIHYLHN---VDGYDGIELKGIEKQ---FNASLSTYHDLLKIIKDK  EFMDNHKIQEILENIVHTLTIFEDREMIK  633
WP_044674937  562 KDIKAYL-EN--SNGYAGVELKGLEEQ---FNASLPTYHDLLKIIRDK  AFIDAEENQEILEDIVLTLTLFEDREMIR  632
WP_044676715  561 EKLMDFLGKE--FDEFRIVDLLGLDKDnkSFNASLGTYHDLLKKIV-SK  DLLDNPENEDILENVVLTLTLFEDREMIR  634
WP_044680361  562 KDIKAYL-EN--SNGYAGVELKGLEEQ---FNASLPTYHDLLKILRDK  AFIDAEENQEILEDIVLTLTLFEDREMIR  632
WP_049533112  561 DKLLNYLGKE--FDEFRIVDLTGLDKEnkVENSSLGTYHDLRKIL-DK  SFIDNKENQIIEDIIQTLTLFEDREMIR  634
WP_029090905  541 TSLKKWLAEH--EHMTVSVVQGTQKEt-EFATSLQAEHREVKIF-DR  ETVSNPANEEMFEKIIYWSTVFEDKKIMR  612
WP_065066696  568 KKLKNWLVNNqcCS--KDAEIKGFQKEn-QFSTSLTPWIDETNIFGKI  ----DQSNFDLIENIIYDLTVFEDKKIMK  637
AIT42264      562 KQLKEDYFKK--IECEDSVEISGVEDR---FNASLGTYHDLLKIIKDK  DFLDNEENEDILEDIVLTLTLFEDREMIE  633
WP_034440723  568 NQLVKYIENK--EQIIAPEIKGIEDS---FNSNYSTYIDLSKIPDMK  --LLEKDEDEILEEIIKILTIFEDRKVMRK  637
AKQ21048      562 KQLKEDYFKK--IECEDSVEISGVEDR---FNASLGTYHDLLKIIKDK  DFLDNENENEDILEDIVLTLTLFEDREMIE  633
WP_004636532  563 KDIANYLEQ---YGYVDGTDIKGVEDK---FNASLSTYNDLAKIDGAK  AYLDDPEYADVWEDIIKILTIFEDKAMRK  633
WP_002364836  570 KDIIQFYRNE--YN-TEIVTLSGLEED--QFNASFSTYQDLLKCGLTR  AELDHPDNAEKLEDIIKILTIFEDRQRIR  641
WP_016631044  570 KDIIQFYRNE--YN-TEIVTLSGLEED--QFNASFSTYQDLLKCGLTR  AELDHPDNAEKLEDIIKILTIFEDRQRIR  641
EMS75795      306 KKLQQFLSAN--YN-IEDAEHLGVDKA---FNSSYATYHDFLDLAKPN  ELLEQPEMNAMFEDIVKILTIFEDRQRIR  381
WP_002373311  570 KDIIQFYRNE--YN-TEIVTLSGLEED--QFNASFSTYQDLLKCGLTR  AELDHPDNAEKLEDIIKILTIFEDRQRIR  641
WP_002378009  570 KDIIQFYRNE--YN-TEIVTLSGLEED--QFNASFSTYQDLLKCGLTR  AELDHPDNAEKLEDIIKILTIFEDRQRIR  641
WP_002407324  570 KDIIQFYRNE--YN-TEIVTLSGLEED--QFNASFSTYQDLLKCGLTR  AELDHPDNAEKLEDIIKILTIFEDRQRIR  641
WP_002413717  572 KDIIQFYRNE--YN-TEIVTLSGLEED--QFNASFSTYQDLLKCGLTR  AELDHPDNAEKLEDIIKILTIFEDRQRIR  643
WP_010775580  570 KDIIQFYRNE--YN-TEIVTLSGLEED--QFNASFSTYQDLLKCGLTR  AELDHPDNAEKLEDIIKILTIFEDRQRIR  641
WP_010818269  570 KDIIQFYRNE--YN-TEIVTLSGLEED--QFNASFSTYQDLLKCGLTR  AELDHPDNAEKLEDIIKILTIFEDRQRIR  641
WP_010824395  570 KDIIQFYRNE--YN-TEIVTLSGLEED--QFNASFSTYQDLLKCGLTR  AELDHPDNAEKLEDIIKILTIFEDRQRIR  641
WP_016622645  570 KDIIQFYRNE--YN-TEIVTLSGLEED--QFNASFSTYQDLLKCGLTR  AELDHPDNAEKLEDIIKILTIFEDRQRIR  641
WP_033624816  570 KDIIQFYRNE--YN-TEIVTLSGLEED--QFNASFSTYQDLLKCGLTR  AELDHPDNAEKLEDIIKILTIFEDRQRIR  641
WP_033625576  570 KDIIQFYRNE--YN-TEIVTLSGLEED--QFNASFSTYQDLLKCGLTR  AELDHPDNAEKLEDIIKILTIFEDRQRIR  641
WP_033789179  570 KDIIQFYRNE--YN-TEIVTLSGLEED--QFNASFSTYQDLLKCGLTR  AELDHPDNAEKLEDIIKILTIFEDRQRIR  641
WP_002310644  567 KDLQEFLYLK--YD-IKHAELSGIEKA---FNASYTTYHDFLTMSENK  QWLEDPELASMFEEIIKTLTVFEDREMIK  641
WP_002312694  568 KDLQEFLYLK--YD-IKHAELSGIEKA---FNASYTTYHDFLTMSENK  QWLEDPELASMFEEIIKTLTVFEDREMIK  642
WP_002314015  568 KDLQEFLYLK--YD-IKHAELSGIEKA---FNASYTTYHDFLTMSENK  QWLEDPELASMFEEIIKTLTVFEDREMIK  642
WP_002320716  568 KDLQEFLYLK--YD-IKHAELSGIEKA---FNASYTTYHDFLTMSENK  QWLEDPELASMFEEIIKTLTVFEDREMIK  642
```

-continued

| | | | |
|---|---|---|---|
| WP_002330729 | 567 | KDLQEFLYLK--YD-IKHAELSGIEKA----FNASYTTYHDFLTMSENK | QWLEDPELASMFEEIIKTLTVFEDREMIK | 641 |
| WP_002335161 | 568 | KDLQEFLYLK--YD-IKHAELSGIEKA----FNASYTTYHDFLTMSENK | QWLEDPELASMFEEIIKTLTVFEDREMIK | 642 |
| WP_002345439 | 568 | KDLQEFLYLK--YD-IKHAELSGIEKA----FNASYTTYHDFLTMSENK | QWLEDPELASMFEEIIKTLTVFEDREMIK | 642 |
| WP_034867970 | 562 | KKLQNFLYTH--YH-IENAQIFGIEKA----FNASYSTYHDFMKLAKTN | EWLEQPEMEPIFEDIVKILTIFEDRQMIK | 637 |
| WP_047937432 | 568 | KDLQEFLYLK--YD-IKHAELSGIEKA----FNASYTTYHDFLTMSENK | QWLEDPELASMFEEIIKTLTVFEDREMIK | 642 |
| WP_010720994 | 562 | KKLQNFLYTH--YH-IENAQIFGIEKA----FNASYSTYHDFMKLAKTN | EWLEQPEMEPIFEDIVKILTIFEDRQMIK | 637 |
| WP_010737004 | 562 | KKLQNFLYTH--YH-IENAQIFGIEKA----FNASYSTYHDFMKLAKTN | EWLEQPEMEPIFEDIVKILTIFEDRQMIK | 637 |
| WP_034700478 | 562 | KKLQNFLYTH--YH-IENAQIFGIEKA----FNASYSTYHDFMKLAKTN | EWLEQPEMEPIFEDIVKILTIFEDRQMIK | 637 |
| WP_007209003 | 564 | KKLENYLRIE1---SISSPSVKGIEEQ---FNANFGTYLDLKKFPDELH | PYLDDEKYQDTLEEVIKVLTVFEDRSMIQ | 634 |
| WP_023351917 | 560 | KQLRKFLELN--EQ-IDSTEIKGIETS---FNASYGTYHDLLKLS--- | TLLDDPDMTTMFEEIIKILTIFEDREMIR | 631 |
| WP_010770040 | 564 | KLLEKFLSNE--FG-LVDVAIKGIE-T--FNAGYGTYHDFLKLIGITR | EQLDKEENSETLEEIVKILTVFEDRKMIR | 634 |
| WP_048604708 | 560 | KDLSNFLRNE--YN-LDDVIIDGIE-N--KFNASFNTYHDFLKLIKDP | KVLDDPANEPMFEEIVKILTIFEDRKMLR | 630 |
| WP_010750235 | 561 | KKLQHFLSAN--YN-IEDAEILGVDKV--FNSSYATYHDFLELAKPY | ELLEQPEMEEMFEDIVKLITIFEDREMVR | 636 |
| AII16583 | 601 | KQLKEDYFKK--IECFDSVEISGVEDR--FNASLGTYHDLLKIIKDK | DFLDNEENEDILEDIVLTLTLFEDREMIE | 672 |
| WP_029073316 | 576 | NAMKKWLVKNqyFSNTDDIKIEGFQKEN-ACSTSLTPWIDFTKIFGEI | ---NNSNYELIEKIIYDVTVFEDKKILR | 647 |
| WP_031589969 | 576 | NAMKKWLVKNqyFSNTDDIKIEGFQKEh-ACSTSLTPWIDFTKIFGKI | ---NESNYDFIEKIIYDVTVFEDKKLIR | 647 |
| KDA45870 | 558 | KMVIKHLKVV--MPAIRIQALKGLDNGk-FNASYGTYKDLVDMGVAP | ELLNDEVNSEKWEDIIKTLTIFEGRKLIK | 630 |
| WP_039099354 | 579 | KNIQDYLVSEk--RYASRPAITGLSDEnk-FNSRLSTYHDLKTIVGDA | --VDDVDKQADLEKCIEWSTIFEDGKIYS | 650 |
| AKP02966 | 561 | KKLTKWLIAQg---YYKNPILIGLSQKQ-EFNSTLTTYLDMKKIFGSS | -FMENNKNYNQIEELIEWLTIFEDKQILN | 632 |
| WP_010991369 | 567 | KDLELFLRNM--SH-VESPTIEGLE-D--SFNSSYSTYHDLLKVGIKQ | EILDNPVNTEMLENIVKILTVFEDKRMIK | 637 |
| WP_033385504 | 570 | KDLELFLRNM--SH-VESPTIEGLE-D--SFNSSYSTYHDLLKVGIKQ | EILDNPVNTEMLENIVKILTVFEDKRMIK | 640 |
| EHN60060 | 336 | KDLELFLRNM--SH-VESPTIEGLE-D--AFNSSFATYHDLQKGGVTQ | EILDNPLNADMLEEIVKILTVFEDKRMIK | 406 |
| WP_038409211 | 186 | KDLERFLYTI--NH-IESPTIEGVE-D--SFNASYATYHDLLKVGLKQ | EILDNPLNADMLEEIVKILTVFEDKRMIK | 256 |
| EFR89594 | 567 | KDLELFLRNI--NH-IESPTIEGLE-D--AFNSSFATYHDLQKGGVTQ | EILDNPLNTEILEDIVKILTVFEDKPMIK | 637 |
| EFR95520 | 567 | KDLELFLRNI--NH-IESPTIEGLE-D--SFNASYATYHDLLKVGLKQ | EILDNPLNTEILEDIVKILTVFEDKPMIK | 637 |
| WP_003723650 | 567 | KDLEQFLRNM--SH-IESPTIEGLE-D--SFNASYATYHDLLKVGIKQ | EVLENPLNTEMLEDIVKILTVFEDKPMIK | 637 |
| WP_003730785 | 567 | KDLELFLRNI--NH-IESPTIEGLE-D--SFNASYATYHDLLKVGMKQ | EILDNPLNTEMLEDIVKILTVFEDKRMIK | 637 |
| WP_003733029 | 567 | KDLELFLRNI--NH-IESPTIEGLE-D--SFNASYATYHDLLKVGMKQ | EILDNPLNTEMLEDIVKILTVFEDKRMIK | 637 |
| WP_003739838 | 567 | KDLELFLRNI--NH-IESPTIEGLE-D--SFNASYATYHDLLKVGMKQ | EILDNPLNTEMLEDIVKILTVFEDKRMIK | 637 |
| WP_014601172 | 570 | KDLELFLRNI--NH-VESPTIEGLE-D--SFNASYATYHDLMKVGIKQ | EILDNPLNTEMLEDIVKILTVFEDKPMIK | 640 |
| WP_023548323 | 567 | KDLELFLRNI--NH-VESPTIEGLE-D--SFNASYATYHDLMKVGIKQ | EILDNPLNTEMLEDIVKILTVFEDKRMIK | 637 |
| WP_031665337 | 567 | KDLELFLRNI--NQ-IESPTIEGLE-D--SFNASYATYHDLLKVGMKQ | EILDNPLNTEMLEDIVKILTVFEDKRMIK | 637 |
| WP_031669209 | 567 | KDLELFLRNI--NQ-IESPTIEGLE-D--SFNASYATYHDLLKVGMKQ | EILDNPLNTEMLEDIVKILTVFEDKRMIK | 637 |
| WP_033920898 | 567 | KDLELFLRNI--NQ-IESPTIEGLE-D--SFNASYATYHDLMKVGIKQ | EILDNPLNTEMLEDIVKILTVFEDKRMIK | 637 |
| AKI42028 | 570 | KDLELFLRNI--NH-VESPTIEGLE-D--SFNASYATYHDLMKVGIKQ | EILDNPLNTEMLEDIVKILTVFEDKPMIK | 640 |
| AKI50529 | 570 | KDLELFLRNI--NH-VESPTIEGLE-D--SFNASYATYHDLMKVGIKQ | EILDNPLNTEMLEDIVKILTVFEDKPMIK | 640 |
| EFR83390 | 15 | KDLELFLRNI--NQ-IESPTIEGLE-D--SFNASYATYHDLMKVGIKQ | EILDNPLNTEMLEDIVKILTVFEDKRMIK | 85 |
| WP_046323366 | 567 | KDLELFLYNM--VH-VESPTVEGVE-D--AFNSSFTTYHDLQKVGVPQ | DFLDDPLNTEMLEEIIKILTLTLFEDKRMIN | 637 |
| AKE81011 | 578 | ERLQAYDSLFDEKVIKALTR-RHYTGWGKLSAKLINGICDK | ----DQSNFDLIEKIIYDLTVFEDKKIMK | 649 |
| CU082355 | 572 | KKLKNWLVNNqcCR--KDAEIKGFQKEn-QFSTSLTPWIDFTNIFGKI | ----NASNYQLIEKIIYDISIFEDKKILK | 641 |
| WP_033162887 | 573 | KKLKDWLVThqYDINEELKIEGYQKD1-QFSTSLAPWIDFTKIFGEI | DFLDNEENEDILEDIVLTLTLFEDREMIE | 644 |
| AGZ01981 | 595 | KQLKEDYFKK--IECFDSVEISGVEDR--FNASLGTYHDLLKIIKDK | DFLDNEENEDILEDIVLTLTLFEDREMIE | 666 |
| AKA60242 | 562 | KQLKEDYFKK--IECFDSVEISGVEDR--FNASLGTYHDLLKIIKDK | DFLDNEENEDILEDIVLTLTLFEDREMIE | 633 |
| AKS40380 | 562 | KQLKEDYFKK--IECFDSVEISGVEDR--FNASLGTYHDLLKIIKDK | DFLDNEENEDILEDIVLTLTLFEDREMIE | 633 |
| 4UN5_B | 566 | KQLKEDYFKK--IECFDSVEISGVEDR--FNASLGTYHDLLKIIKDK | DFLDNEENEDILEDIVLTLTLFEDREMIE | 637 |
| WP_010922251 | 634 | ERLKTYAHLFDDKVMKQLKR-RRYTGMGRLSRKLINGIRDK | QSGKTILDFLK -DGf---ANRNFMQLIHDDSL | 702 |
| WP_039695303 | 638 | ERLQKYSDIFTANQLKKLER-RHYTGWGRLSYKLINGIRNK | ENNKTILDYLI DDG---SANRNFMQLINDDTL | 706 |
| WP_045635197 | 633 | QRLAQYDSLFDEKVIKALTR-RHYTGWGKLSAKLINGICDK | QTGNTILDYLI DDG---KINRNFMQLINDDGL | 701 |
| 5AXW_A | 369 | EELTNLNSELTQEEIEQLSN1KGYTGTHNLSKAINILIDE | -------LW ------TNDNQIAIPNRLKL | 426 |

```
WP_009880683  318  ERLKTYAHLFDDKVMKQLKR-RRYTGWGRLSRKLINGIRDK  QSGKTILDFLK  -DGf---ANRNFMQLIHDDSL  386
WP_010922251  634  ERLKTYAHLFDDKVMKQLKR-RRYTGWGRLSRKLINGIRDK  QSGKTILDFLK  -DGf---ANRNFMQLIHDDSL  702
WP_011054416  634  ERLKTYAHLFDDKVMKQLKR-RRYTGWGRLSRKLINGIRDK  QSGKTILDFLK  -DGf---ANRNFMQLIHDDSL  702
WP_011284745  634  ERLKTYAHLFDDKVMKQLKR-RRYTGWGRLSRKLINGIRDK  QSGKTILDFLK  -DGf---ANRNFMQLIHDDSL  702
WP_011285506  634  ERLKTYAHLFDDKVMKQLKR-RRYTGWGRLSRKLINGIRDK  QSGKTILDFLK  -DGf---ANRNFMQLIHDDSL  702
WP_011527619  634  ERLKTYAHLFDDKVMKQLKR-RRYTVWGRLSRKLINGIRDK  QSGKTILDFLK  -DGf---ANRNFMQLIHDDSL  702
WP_012560673  634  ERLKTYAHLFDDKVMKQLKR-RRYTGWGRLSRKLINGIRDK  QSGKTILDFLK  -DGf---ANRNFMQLIHDDSL  702
WP_014407541  634  ERLKTYAHLFDDKVMKQLKR-RRYTGWGRLSRKLINGIRDK  QSGKTILDFLK  -DGf---ANRNFMQLIHDDSL  702
WP_020905136  634  ERLKTYAHLFDDKVMKQLKR-RRYTGWGRLSRKLINGIRDK  QSGKTILDFLK  -DGf---ANRNFMQLIHDDSL  702
WP_023080005  634  ERLKKYANLFDDKVMKQLKR-RRYTGWGRLSRKLINGIRDK  QSGKTILDFLK  -DGf---ANRNFMQLIHDDSL  702
WP_023610282  634  ERLKTYAHLFDDKVMKQLKR-RHYTGWGRLSRKLINGIRDK  QSGKTILDFLK  -DGf---ANRNFMQLINDDSL  702
WP_030125963  634  ERLKTYAHLFDDKVMKQLKR-RRYTGWGRLSRKLINGIRDK  QSGKTILDFLK  -DGf---ANRNFMQLIHDDSL  702
WP_030126706  634  ERLKTYAHLFDDKVMKQLKR-RRYTGWGRLSRKLINGIRDK  QSGKTILDFLK  -DGf---ANRNFMQLIHDDSL  702
WP_031488318  634  ERLKTYAHLFDDKVMKQLKR-RRYTGWGRLSRKLINGIRDK  QSGKTILDFLK  -DGf---ANRNFMQLIHDDSL  702
WP_032460140  634  ERLKTYAHLFDDKVMKQLKR-RRYTGWGRLSRKLINGIRDK  QSGKTILDFLK  -DGf---ANRNFMQLIHDDSL  702
WP_032461047  634  ERLKTYAHLFDDKVMKQLKR-RRYTGWGRLSRKLINGIRDK  QSGKTILDFLK  -DGf---ANRNFMQLIHDDSL  702
WP_032462016  634  ERLKTYAHLFDDKVMKQLKR-RRYTGWGRLSRKLINGIRDK  QSGKTILDFLK  -DGf---ANRNFMQLIHDDSL  702
WP_032462936  634  ERLKKYAHLFDDKVMKQLKR-RRYTGWGRLSRKLINGIRDK  QSGKTILDFLK  -DGf---ANRNFMQLIHDDSL  702
WP_032464890  459  ERLKTYAHLFDDKVMKQLKR-RRYTGWGRLSRKLINGIRDK  QSGKTILDFLK  -DGf---ANRNFMQLIHDDSL  527
WP_033888930  634  ERLKTYAHLFDDKVMKQLKR-RRYTGWGRLSRKLINGIRDK  QSGKTILDFLK  -DGf---ANRNFMQLIHDDSL  702
WP_038431314  634  ERLKTYAHLFDDKVMKQLKR-RHYTGWGRLSRKLINGIRDK  QSGKTILDFLK  -DGf---ANRNFMQLINDDSL  702
WP_038432938  634  ERLKTYAHLFDDKVMKQLKR-RRYTGWGRLSRKLINGIRDK  QSGKTILDFLK  -DGf---ANRNFMQLIHDDSL  702
WP_038434062  634  ERLKTYAHLFDDKVMKQLKR-RRYTGWGRLSRKLINGIRDK  QSGKTILDFLK  -DGf---ANRNFMQLIHDDSL  702
BAQ51233      545  ERLKTYAHLFDDKVMKQLKR-RRYTGWGRLSRKLINGIRDK  QSGKTILDFLK  -DGf---ANRNFMQLIHDDSL  613
KGE60162           -----------------------------------------  -----------  --------------------
KGE60856      634  ERLKTYAHLFDDKVMKQLKR-RRYTGWGRLSRKLINGIRDK  QSGKTILDFLK  -DGf---ANRNFMQLINDDSL  702
WP_002989955  635  QRLQKYSDIFTKAQLKKLER-RHYTGWGRLSYKLINGIRDK  ENKTILDYLI   DDG---YANRNFMQLINDDAL  703
WP_003030200  638  ERLQKYSDIFTADQLKKLER-RHYTGWGRLSYKLINGIRNK  ENNKTILDYLI  DDG---SANRNFMQLINDDTL  706
WP_003065552  633  KRLDIYKDFFTESQLKKLYR-RHYTGWGRLSAKLINGIRNK  ENQKTILDYLI  DDG---SANRNFMQLIKDAGL  701
WP_001040076  636  KRLENYKDLFTESQLKKLYR-RHYTGWGRLSAKLINGIRNK  ESQKTILDYLI  DDG---RSNRNFMQLINDDGL  704
WP_001040078  636  KRLENYKDLFTESQLKKLYR-RHYTGWGRLSAKLINGIRNK  ESQKTILDYLI  DDG---RSNRNFMQLINDDGL  704
WP_001040080  636  KRLENYKDLFTESQLKKLYR-RHYTGWGRLSAKLINGIRNK  ESQKTILDYLI  DDG---RSNRNFMQLINDDGL  704
WP_001040081  636  KRLENYKDLFTESQLKKLYR-RHYTGWGRLSAKLINGIRNK  ESQKTILDYLI  DDG---RSNRNFMQLINDDGL  704
WP_001040083  636  KRLENYKDLFTESQLKKLYR-RHYTGWGRLSAKLINGIRDR  ESQKTILDYLI  SDG---RANRNFMQLINDDGL  704
WP_001040085  636  KRLENYKDLFTESQLKKLYR-RHYTGWGRLSAKLINGIRNK  ESQKTILDYLI  DDG---RSNRNFMQLINDDGL  704
WP_001040087  633  KRLDIYKDFFTESQLKKLYR-RHYTGWGRLSAKLINGIRNK  ENQKTILDYLI  DDG---SANRNFMQLIKDAGL  701
WP_001040088  636  KRLENYKDLFTESQLKKLYR-RHYTGWGRLSAKLINGIRNK  ESQKTILDYLI  DDG---RSNRNFMQLINDDGL  704
WP_001040089  636  KRLENYKDLFTESQLKKLYR-RHYTGWGRLSAKLINGIRNK  ESQKTILDYLI  DDG---SANRNFMQLIKDAGL  704
WP_001040090  636  KRLENYKDLFTESQLKKLYR-RHYTGWGRLSAKLINGIRNK  ESQKTILDYLI  DDG---SANRNFMQLINDDGL  704
WP_001040091  636  KRLENYKDLFTESQLKKLYR-RHYTGWGRLSAKLINGIRNK  ESQKTILDYLI  DDG---SANRNFMQLIKDAGL  704
WP_001040092  633  KRLDIYKDFFTESQLKKLYR-RHYTGWGRLSAKLINGIRNK  ENQKTILDYLI  DDG---SANRNFMQLIKDAGL  701
WP_001040094  633  KRLDIYKDFFTESQLKKLYR-RHYTGWGRLSAKLINGIRNK  ENQKTILDYLI  DDG---SANRNFMQLIKDAGL  701
WP_001040095  633  KRLDIYKDFFTESQLKKLYR-RHYTGWGRLSAKLINGIRNK  ENQKTILDYLI  DDG---SANRNFMQLIKDAGL  701
WP_001040096  636  KRLENYKDLFTESQLKKLYR-RHYTGWGRLSAKLINGIRNK  ESQKTILDYLI  DDG---SANRNFMQLIKDAGL  704
WP_001040097  636  KRLENYKDLFTESQLKKLYR-RHYTGWGRLSAKLINGIRNK  ESQKTILDYLI  DDG---SANRNFMQLIKDAGL  704
WP_001040098  633  KRLDIYKDFFTESQLKKLYR-RHYTGWGRLSAKLINGIRNK  ENQKTILDYLI  DDG---SANRNFMQLIKDAGL  701
WP_001040099  633  KRLDIYKDFFTESQLKKLYR-RHYTGWGRLSAKLINGIRNK  ENQKTILDYLI  DDG---SANRNFMQLIKDAGL  701
WP_001040100  636  KRLENYKDLFTESQLKKLYR-RHYTGWGRLSAKLINGIRNK  ESQKTILDYLI  DDG---SANRNFMQLIHDDGL  704
WP_001040105  636  KRLENYKDLFTESQLKKLYR-RHYTGWGRLSAKLINGIRNK  ESQKTILDYLI  DDG---RSNRNFMQLIKDAGL  704
WP_001040106  636  KRLENYKDLFTESQLKKLYR-RHYTGWGRLSAKLINGIRNK  ESQKTILDYLI  SDG---RANRNFMQLIHDDGL  704
WP_001040107  636  KRLENYKDLFTESQLKKLYR-RHYTGWGRLSAKLINGIRNK  ESQKTILDYLI  SDG---RANRNFMQLINDDGL  704
WP_001040108  636  KRLENYKDLFTESQLKKLYR-RHYTGWGRLSAKLINGIRNK  ESQKTILDYLI  SDG---RANRNFMQLINDDGL  704
```

-continued

```
WP_001040109    636 KRLENYKDLFTESQLKKLYR-RHYTGWGRLSAKLINGIRDK ESQKTILDYLI SDG---RANRNFMQLIHDDGL 704
WP_001040110    636 KRLENYKDLFTESQLKKLYR-RHYTGWGRLSAKLINGIRDK ESQKTILDYLI SDG---RANRNFMQLIHDDGL 704
WP_015058523    636 KRLENYKDLFTESQLKKLYR-RHYTGWGRLSAKLINGIRDR ESQKTILDYLI SDG---RANRNFMQLINDDGL 704
WP_017643650    633 KRLDIYKDFFTESQLKKLYR-RHYTGWGRLSAKLINGIRNK ENQKTILDYLI DDG---SANRNFMQLIKDAGL 701
WP_017647151    636 KRLENYKDLFTESQLKKLYR-RHYTGWGRLSAKLINGIRDK ESQKTILDYLI DDG---KSNRNFMQLIHDDGL 704
WP_017648376    636 KRLENYKDLFTESQLKKLYR-RHYTGWGRLSAKLINGIRDK ESQKTILDYLI DDG---KSNRNFMQLIHDDGL 704
WP_017649527    636 KRLENYKDLFTESQLKKLYR-RHYTGWGRLSAKLINGIRDK ESQKTILDYLI DDG---RSNRNFMQLIHDDGL 704
WP_017771611    636 KRLENYKDLFTESQLKKLYR-RHYTGWGRLSAKLINGIRDK ESQKTILDYLI SDG---RANRNFMQLIHDDGL 704
WP_017771984    636 KRLENYKDLFTESQLKKLYR-RHYTGWGRLSAKLINGIRDK ESQKTILDYLI DDG---RSNRNFMQLINDDGL 704
CFQ25032        636 KRLENYKDLFTESQLKKLYR-RHYTGWGRLSAKLINGIRDK ESQKTILDYLI DDG---RSNRNFMQLIHDDGL 704
CFV16040        636 KRLENYKDLFTESQLKKLYR-RHYTGWGRLSAKLINGIRDK ESQKTILDYLI DDG---RSNRNFMQLINDDGL 704
KLJ37842        636 KRLDIYKDLFTESQLKKLYR-RHYTGWGRLSAKLINGIRNK ESQKTILDYLI DDG---RSNRNFMQLINDDGL 704
KLJ72361        636 KRLENYKDLFTESQLKKLYR-RHYTGWGRLSAKLINGIRDK ESQKTILDYLI SDG---RANRNFMQLINDDGL 718
KLL20707        636 KRLENYKDLFTESQLKKLYR-RHYTGWGRLSAKLINGIRDK ESQKTILDYLI DDG---RSNRNFMQLINDDGL 704
KLL42645        636 KRLENYKDLFTESQLKKLYR-RHYTGWGRLSAKLINGIRDK ESQKTILDYLI DDG---RSNRNFMQLINDDGL 704
WP_047207273    633 KRLDIYKDLFTESQLKKLYR-RHYTGWGRLSAKLINGIRNK ENQKTILDYLI DDG---SANRNFMQLIKDAGL 701
WP_047209694    636 KRLENYKDLFTESQLKKLYR-RHYTGWGRLSAKLINGIRDK ESQKTILDYLI DDG---RSNRNFMQLINDDGL 704
WP_050198062    636 KRLENYKDLFTESQLKKLYR-RHYTGWGRLSAKLINGIRDK ESQKTILDYLI SDG---RANRNFMQLIHDDGL 704
WP_050199062    636 KRLDIYKDLFTESQLKKLYR-RHYTGWGRLSAKLINGIRNK ESQKTILDYLI DDG---RSNRNFMQLINDDGL 704
WP_050201642    636 KRLENYKDLFTESQLKKLYR-RHYTGWGRLSAKLINGIRDK ESQKTILDYLI DDG---RSNRNFMQLINDDGL 704
WP_050204027    636 KRLENYKDLFTESQLKKLYR-RHYTGWGRLSAKLINGIRDK ESQKTILDYLI SDG---RANRNFMQLINDDGL 704
WP_050881965    636 KRLENYKDLFTESQLKKLYR-RHYTGWGRLSAKLINGIRDK ESQKTILDYLI DDG---RSNRNFMQLINDDGL 704
WP_050888065    636 KRLENYKDLFTESQLKKLYR-RHYTGWGRLSAKLINGIRDK ESQKTILDYLI SDG---RANRNFMQLINDDGL 704
AHN30376        636 KRLENYKDLFTESQLKKLYR-RHYTGWGRLSAKLINGIRDR ESQKTILDYLI DDG---RSNRNFMQLINDDGL 704
EA078426        636 KRLENYKDLFTESQLKKLYR-RHYTGWGRLSAKLINGIRDK ESQKTILDYLI DDG---RSNRNFMQLINDDGL 704
CCW42055        635 KRLDIYKDFFTESQLKKLYR-RHYTGWGRLSAKLINGIRNK ENQKTILEYLV DDG---SANRNFMQLINDDGL 703
WP_003041502    636 QRLQKYSDIFTKAQLKKLER-RHYTGWGRLSYKLINGIRNK ENKKTILDFLK DDG---YANRNFMQLIHDDSL 704
WP_037593752    635 QRLQKYSDIFTKAQLKKLER-RHYTGWGRLSYKLINGIRNK ENKKTILDFLK DDG---YANRNFMQLINDDAL 703
WP_049516684    636 QRLQKYSDIFTQQLKKLER-RHYTGWGRLSYKLINGIRNK ENKKTILDFLK DDG---YANRNFMQLINDDAL 704
GAD46167        635 QRLQKYSDIFTKAQLKKLER-RHYTGWGRLSYKLINGIRNK ESQKTILDYLI DDG---SANRNFMQLINDDAL 703
WP_018363470    636 QRLQKYSDIFTKAQLKKLER-RHYTGWGRLSYKLINGIRNK ENKKTILDFLK DDG---SANRNFMQLINDDAL 704
WP_003043819    644 ERLKTYAHLFDDKVMKQLKR-RHYTGWGRLSRKMINGIRDK QSGf--SNRNFMQLIHDDSL 712
WP_006269658    635 ERLKTYAHLFDDKVMKQLKR-RHYTGWGRLSRKLINGIRDK ENKKTILDFLK -Dgf--ANRNFMQLINDDAL 703
WP_048800889    635 QRLQKYSDIFTKAQLKKLER-RHYTGWGRLSYKLINGIRNK ENKKTILDFLK -Dgf--YANRNFMQLINDDTL 703
WP_012767106    634 ERLKKYANLFDDKVMKQLKR-RHYTGWGRLSYKLINGIRNK ENKTILEYLV -Dgf--ANRNFMQLIHDDSL 702
WP_014612333    635 ERLKTYAHLFDDKVMKQLKR-RHYTGWGRLSYKLINGIRNK QSGKTILDFLK -Dgf--ANRNFMQLINDDSL 703
WP_015017095    634 ERLKTYAHLFDDKVMKQLKR-RHYTGWGRLSRKLINGIRNK QSGKTILDFLK -Dgf--ANRNFMQLINDDSL 702
WP_015057649    634 QRLQKYSDIFTPQQLKKLER-RHYTGWGRLSQKLINGIRDK QSGKTILDFLK -Dgf--YANRNFMQLISDDTL 702
WP_048277215    634 ERLQKYSDIFTANQLKKLER-RHYTGWGRLSYKLINGIRNK QSGKTILDFLK -Dgf--ANRNFMQLINDDSL 702
WP_049515931    634 ERLQKYSDIFTANQLKKLER-RHYTGWGRLSYKLINGIRNK QSGKTILDFLK -Dgf--SNRNFMQLIHDDSL 702
WP_021320964    634 KRLDQYAHLFDDKVVLNKLR-HHYTGWGRLSGKLINGIRNK QSGKTILDFLK -Dgf--ANRNFMQLIHDSEL 702
WP_037581760    634 KRLDQYAHLFDKVVLNKLR-HHYTGWGRLSGKLINGIRNK QSGKTILDFLK -Dgf--ANRNFMQLINDDTL 702
WP_004232481    635 ERLQKYSDIFTSQQLKKLER-RHYTGWGRLSYKLINGIRNK ENKTILDFLI DDG---DANRNFMQLINDDSL 703
WP_009854540    636 ERLKTYANLFDDKVFEKSVLKKLR-RHYTGWGRLSYKLINGIRNK ENKTILDFLI DDG---SANRNFMQLINDDSL 704
WP_012962174    636 ERLKKYANLFDDKVFEKSVLKKLR-RHYTGWGRLSYKLINGIRNK ENGKTILDFLK DDG---YANRNFMQLINDDTL 704
WP_039695303    638 ERLQKYSDIFTSQQLKKLER-RHYTGWGRLSYKLINGIRNK ENNKTILDFLI DDG---SANRNFMQLINDDTL 706
WP_014334983    635 ERLKTYAHLFDSFFTSQQLKKLER-RHYTGWGRLSYKLINGIRNK ENKTILDFLI DDG---HANRNFMQLINDESL 703
WP_030099269    634 KRLDQYAHLFDKVVLNKLR-HHYTGWGRLSGKLINGIKDK QTGKTILDFLK DDG---ANRNFMQLIHDSEL 702
AHY15608        634 RRLVKYADVFEKSVLKKLKK-RHYTGWGRLSQKLINGIKDK QTGKTILGFLK DDG---ANRNFMQLISDDTL 702
AHY17476        634 RRLVKYADVFEKSVLKKLKK-RHYTGWGRLSQKLINGIKDK QTGKTILGFLK -Dgv--ANRNFMQLINDSSL 702

ESR09100
AGM98575        634 RRLVKYADVFEKSVLKKLKK-RHYTGWGRLSQKLINGIKDK QTGKTILGFLK -Dgv--ANRNFMQLINDSSL 702
ALF27331        635 KRLENYSDLLTKEQVKNLER-RHYTGWGRLSAELIHGIRNK ESRKTILDYLI DDG---NSNRNFMQLINDDAL 703
```

```
                       -continued

WP_018372492   648 KRLSELNIPFENKIIKKLAR-KKYTGWGNLSRKLIDGIRNR  ETNRTILGHLI  DDGf--SNRNLMQLINDDGL  716
WP_045618028   634 QRLAHYASIFDEKVIKALTR-RHYTGWGKLSAKLINGIYDK  QSKKTILDYLI  DDG---EINRNFMQLINDDGL 702
WP_045635197   633 QRLAQYDSLFDEKVIKALTR-RHYTGWGKLSAKLINGICDK  QTGNTILDYLI  DDG---KINRNFMQLINDDGL 701
WP_002263549   635 KRLENYSDLLTKEQVKKLER-RHYTGWGRLSAELIHGIRNK  ESRKTILDYLI  DDG---NSNRNFMQLINDDAL 703
WP_002263887   635 KRLENYSDLLTKEQVKKLER-RHYTGWGRLSAELIHGIRNK  ESRKTILDYLI  DDG---NSNRNFMQLINDDAL 703
WP_002264920   635 KRLKNYSDLLTKEQLKKLER-RHYTGWGRLSAELIHGIRNK  ESRKTILDYLI  DDG---NSNRNFMQLINDDAL 703
WP_002269043   635 KRLENYSDLLTKEQLKKLER-RHYTGWGRLSAELIHGIRNK  ESRKTILDYLI  DDG---NSNRNFMQLINDDAL 703
WP_002269448   635 KRLENYSDLLTKEQVKKLER-RHYTGWGRLSAELIHGIRNK  ESRKTILDYLI  DDG---NSNRNFMQLINDDAL 703
WP_002271977   635 KRLENYSDLLTKEQVKKLER-RHYTGWGRLSAELIHGIRNK  ESRKTILDYLI  DDG---NSNRNFMQLINDDAL 703
WP_002272766   635 KRLENYSDLLTKEQVKKLER-RHYTGWGRLSAELIHGIRNK  ESRKTILDYLI  DDG---NSNRNFMQLINDDAL 703
WP_002273241   635 KRLENYSDLLTKEQVKKLER-RHYTGWGRLSAELIHGIRNK  ESRKTILDYLI  DDG---NSNRNFMQLINDDAL 703
WP_002275430   635 KRLENYSDLLTKEQVKKLER-RHYTGWGRLSAELIHGIRNK  ESRKTLLDYLI  DDG---NSNRNFMQLINDDAL 703
WP_002276448   636 QRLAKYADVFDKKVIDQLAR-RHYTGWGRLSAKLLNGIRDK  QSCKTILDYLI  DDA---QSNRNLMQLITDDNL 704
WP_002277050   635 KRLENYSDLLTKEQVKKLER-RHYTGWGRLSAELIHGIRNK  ESRKTILDYLI  DDG---NSNRNFMQLINDDAL 703
WP_002277364   635 KRLENYSDLLTKEQLKKLER-RHYTGWGRLSAELIHGIRNK  ESRKTILDYLI  DDG---NSNRNFMQLINDDAL 703
WP_002279025   635 KRLENYSDLLTKEQVKKLER-RHYTGWGRLSAELIHGIRNK  ESRKTILDYLI  DDG---NSNRNFMQLINDDAL 703
WP_002279859   635 KRLENYSDLLTKEQVKKLER-RHYTGWGRLSAELIHGIRNK  ESRKTILDYLI  DDG---NSNRNFMQLINDDAL 703
WP_002280230   635 KRLKNYSDLLTKEQVKKLER-RHYTGWGRLSAELIHGIRNK  ESRKTILDYLI  DDG---NSNRNFMQLINDDAL 703
WP_002281696   635 KRLENYSDLLTKEQLKKLER-RHYTGWGRLSAELIHGIRNK  ESRKTILDYLI  DDG---NSNRNFMQLINDDAL 703
WP_002282247   636 QRLAKYADVFDKKVIDQLAR-RHYTGWGRLSAKLLNGIRDK  QSCKTILDYLI  DDA---QSNRNLMQLITDDNL 704
WP_002282906   635 KRLENYSDLLTKEQVKKLER-RHYTGWGRLSAELIHGIRNK  ESRKTILDYLI  DDG---NSNRNFMQLINDDAL 703
WP_002283846   635 KRLKNYSDLLTKEQVKKLER-RHYTGWGRLSAELIHGIRNK  ESRKTILDYLI  DDG---NSNRNFMQLINDDAL 703
WP_002287255   635 KRLENYSDLLTKEQLKKLER-RHYTGWGRLSAELIHGIRNK  ESRKTILDYLI  DDG---NSNRNFMQLINDDAL 703
WP_002288990   635 KRLENYSDLLTKEQVKKLER-RHYTGWGRLSAELIHGIRNK  ESRKTILDYLI  DDG---NSNRNFMQLINDDAL 703
WP_002289641   635 KRLENYSDLLTKEQLKKLER-RHYTGWGRLSAELIHGIRNK  ESRKTILDYLI  DDG---NSNRNFMQLINDDAL 703
WP_002290427   635 KRLKNYSDLLTKEQVKKLER-RHYTGWGRLSAELIHGIRNK  ESRKTILDYLI  DDG---NSNRNFMQLINDDAL 703
WP_002295753   635 KRLENYSDLLTKEQLKKLER-RHYTGWGRLSAELIHGIRNK  ESRKTILDYLI  DDG---NSNRNFMQLINDDAL 703
WP_002296423   635 KRLENYSDLLTKEQVKKLER-RHYTGWGRLSAELIHGIRNK  ESRKTILDYLI  DDG---NSNRNFMQLINDDAL 703
WP_002304487   645 QRLQKYSDIFTKAQLKKLER-RHYTGWGRLSYKLINGIRDK  QSNKTILGYLI  DDG---YSNRNFMQLINDDAL 713
WP_002305844   635 KRLENYSDLLTKEQVKKLER-RHYTGWGRLSAELIHGIRNK  ESRKTILDYLI  DDG---NSNRNFMQLINDDAL 703
WP_002307203   635 KRLENYSDLLTKEQVKKLER-RHYTGWGRLSAELIHGIRNK  ESRKTLLDYLI  DDG---NSNRNFMQLINDDAL 703
WP_002310390   635 KRLENYSDLLTKEQLKKLER-RHYTGWGRLSAELIHGIRNK  ESRKTILDYLI  DDG---NSNRNFMQLINDDAL 703
WP_002352408   635 KRLENYSDLLTKEQVKKLER-RHYTGWGRLSAELIHGIRNK  ESRKTLLDYLI  DDG---NSNRNFMQLINDDAL 703
WP_012997688   635 KRLENYSDLLTKEQVKKLER-RHYTGWGRLSAELIHGIRNK  ESRKTILDYLI  DDG---NSNRNFMQLINDDAL 703
WP_014677909   635 KRLKNYSDLLTKEQLKKLER-RHYTGWGRLSAELIHGIRNK  ESRKTILDYLI  DDG---NSNRNFMQLINDDAL 703
WP019312892    635 KRLENYSDLLTKEQLKKLER-RHYTGWGRLSAELIHGIRNK  ESRKTILDYLI  DDG---NSNRNFMQLINDDAL 703
WP_019313659   635 KRLENYSDLLTKEQVKKLER-RHYTGWGRLSAELIHGIRNK  ESRKTILDYLI  DDG---NSNRNFMQLINDDAL 703
WP_019314093   636 QRLAKYADVFDKKVIDQLAR-RHYTGWGRLSAKLLNGIRDK  QSCKTILDYLI  DDA---QSNRNLMQLITDDNL 704
WP_019315370   635 KRLENYSDLLTKEQVKKLER-RHYTGWGRLSAELIHGIRNK  ESRKTILDYLI  DDG---NSNRNFMQLINDDAL 703
WP_019803776   635 KRLENYSDLLTKEQLKKLER-RHYTGWGRLSAELIHGIRNK  ESRKTILDYLI  DDG---NSNRNFMQLINDDAL 703
WP_019805234   628 KRLENYSDLLTKEQVKKLER-RHYTGWGRLSAELIHGIRNK  ESRKTILDYLI  DDG---NSNRNFMQLINDDAL 696
WP_024783594   636 QRLAKYADVFDKKVIDQLAR-RHYTGWGRLSAKLLNGIRDK  QSCKTILDYLI  DDA---QSNRNLMQLITDDNL 704
WP_024784288   636 KRLENYSDLLTKEQVKKLER-RHYTGWGRLSAKLIDGICDK  QTGNTILDYLI  DDA---YNNRNFMQLINDDEL 704
WP_024784666   635 QRLAQYDSLFDEKVIKALIR-RHYTGWGKLSAKLINGIRDK  QTGNTILDYLI  DDG---KNNRNFMQLINDDGL 703
WP_024784894   635 QRLMQYDSIFDEKVIKALTR-RHYTGWGKLSAKLINGIRDK  KTSKTILDYLI  DDG---YSNRNFMQLINDDGL 703
WP_024786433   636 QRLAKYADVFDKKVIDQLAR-RHYTGWGRLSAKLLNGIRDK  QSCKTILDYLI  DDA---QSNRNLMQLITDDNL 704
WP_049473442   635 KRLENYSDLLTKEQVKKLER-RHYTGWGRLSAELIHGIRNK  ESRKTILDYLI  DDG---NSNRNFMQLINDDAL 703
WP_049474547   635 KRLENYSDLLTKEQLKKLER-RHYTGWGRLSAELIHGIRNK  ESRKTILDYLI  DDG---NSNRNFMQLINDDAL 703
EMC03581       628 KRLENYSDLLTKEQVKKLER-RHYTGWGRLSAELIHGIRNK  ESRKTILDYLI  DDG---NSNRNFMQLINDDAL 696
WP_000428612   636 QRLAKYADVFDKKVIKALTR-RHYTGWGKLSAKLIDGICDK  QTGKTILDYLM  DDG---YNNRNFMQLINDDEL 704
WP_000428613   634 QRLAQYDSLFDEKVIKALIR-RHYTGWGKLSAKLIDGICDK  QTGNTILDYLI  DDG---KNNRNFMQLINDDGL 702
WP_049523028   633 QRLAQYDSIFDEKVIKALTR-RHYTGWGKLSAKLINGIRDK  KTSKTILDYLI  DDG---YSNRNFMQLINDDGL 701
WP_003107102   603 KRLSKYESIFDPSILKKLKK-RHYTGWGKLSQKLINDPSLI  QTGKTILDFLI  -DGq--ANRNFMQLINDPSL  671
```

```
                              -continued

WP_054279288  636  NRLAVYEDLFDQNVLKQLKR-RHYTGWGRLSKQLINGMRDK  HTGKTILDFLK  -DGf---INRNFMQLINDDNL  704
WP_049531101  634  QRLAQYASIFDEKVIKTLTR-RHYTGWGKLSAKLINCIRDR  KTGKTILDYLI  DDG---YNNRNFMQLINDDGL  702
WP_049538452  634  QRLAQYDSIFDEKVIKALTR-RHYTGWGKLSAKLINGIRDK  QTGKTILDYLI  DDG---YSNRNFMQLINDDGL  702
WP_049549711  634  QRLAQYDSLFDKKVIKALTR-RHYTGWGKLSAKLINGICDK  QTGNTILDYLI  DDG---EINRNFMQLINDDGL  702
WP_007896501  637  KRLAKYANLFEKSVLKKLRK-RHYRGWGRLSRQLIDGMKDK  ASGKTILDFLK  -DDf---ANRNFMQLINDSSL  705
EFR44625      589  QRLAQYDTLFDEKVIKALTR-RHYTGWGKLSAKLINGIRDK  QSGKTILDYLI  DDD---KINRNFMQLINDDGL  657
WP_002897477  633  QRLAQYDTLFDEKVIKALTR-RHYTGWGKLSAKLINGIRDK  QTGKTILEYLI  DDG---DCNRNFMQLINDDGL  701
WP_002906454  634  QRLAQYDSLFDEKVIKALTR-RHYTGWGKLSAKLINGISDK  QTGNTILDYLI  DDG---EINRNFMQLINDDGL  702
WP_009729476  637  QRLLKYEDIFSKKVIANLTR-RHYTGWGRLSAKLINGIKDK  HSRKTILDYLI  DDG---HSNRNFMQLINDDNL  705
CQR24647      636  QRLAQYDSIFDEKVIKALTR-RHYTGWGKLSAKLINGIRDK  KSGKTILDYLI  DDG---EINRNFMQLIHDDGL  704
WP_009754323  634  QRLAQYDSIFDEKVIKALTR-RHYTGWGKLSAKLINGICDK  KTGKTILDYLI  DDG---YNNRNFMQLINDDGL  702
WP_044674937  633  KRLEKYKDILTEEQRKKLER-RHYTGWGRLSAKLINGILDK  VTRKTILGYLI  DDG---TSNRNFMQLINDDTL  701
WP_044676715  635  KRLEKYKDVLTEEQRKKLER-RHYTGWGRLSAKLINGIRDK  VTRKTILDYLI  DDG---TSNRNFMQLINDDTL  703
WP_044680361  635  KRLEKYKDILTEEQRKKLER-RHYTGWGRLSAKLINGILDK  VTRKTILGYLI  DDG---TSNRNFMQLINDDTL  703
WP_044681799  633  KRLEKYKDILTEEQRKKLER-RHYTGWGRLSAKLINGILDK  VTRKTILDYLI  DDG---TSNRNFMQLINDDTL  701
WP_049533112  635  QRLQKYSDIFTKAQLKKLER-CHYTGWGRLSYKLINGIRNK  ENKKTILDYLI  DDG---YANRNFMQLINDDAL  703
WP_029090905  613  RKLSEYPQLTEQQQVQLAQV--RFRGWGRLSQRLINRIKTP  EDHKLSINEIL  -----QTNENFMQLIRNKDY  682
WP_006506696  638  RRLKKKYALPDDKVKQIIKL--KYKDWSRLSKKLLDGIVAD  SV--TVLDVLE  -SRLNLMEIINDKDL      705
AIT42264      634  ERLKTYAHLFDDKVMKQLKR-RRYTGWGRLSKKLINGIRDE  QSGKTILDYLI  -DGf---ANRNFMQLIHDDSL  702
WP_034440723  638  RQLMKFDKLSEKAINQLSK-KHYTGWGQLSEKLINGIRDE   QSNKTILDFLK  DNGcpkNMNRNFMQLINDDTL  710
AKQ21048      634  ERLKTYAHLFDDKVMKQLKR-RRYTGWGRLSKKLINGIRDE  QSGKTILDFLK  -DGf---ANRNFMQLIHDDSL  702
WP_004636532  634  KQLQTYSDTLSPEILKKLER-KHYTGWGRLSKKLINGIRDE  GSNKTILDYLI  DDGssgPTNRNFMQLIRDNTL  706
WP_002364836  642  TQLSTFKGQFSAEVLKKLER-KHYTGWGRLSKKLINGIRDK  ESGKTILDYLI  DDGvskHYNRNFMQLINDSQL  714
WP_016631044  593  TQLSTFKGQFSAEVLKKLER-KHYTGWGRFSAKLINGIRDK  ESGKTILDYLI  DDGvskHYNRNFMQLINDSQL  665
EMS75795      382  TQLKKYQSVLGDGFEKKLVK-KHYTGWGRLSERLINGIRDK  KTNKTILDYLI  DDGfpyNRRNFMQLINDDSL  454
WP_002373311  642  TQLSTFKGQFSAEVLKKLER-KHYTGWGRLSKKLINGIYDK  ESGKTILDYLI  DDGvskHYNRNFMQLINDSQL  714
WP_002378009  642  TQLSTFKGQFSAEVLKKLER-KHYTGWGRLSKKLINGIYDK  ESGKTILDYLI  DDGvpaNRNRNLMQLINDSQL  714
WP_002407324  642  TQLSTFKGQFSAEVLKKLER-KHYTGWGRLSKKLINGIYDK  ESGKTILDYLI  DDGvskHYNRNFMQLINDSQL  714
WP_002413717  644  TQLSTFKGQFSEEVLKKLER-KHYTGWGRLSKKLINGIYDV  ESGKTILDYLIV DDGvskHYNRNFMQLINDSQL  716
WP_010777580  642  TQLSTFKGQFSAEVLKKLER-KHYTGWGRLSKKLINGIYDK  ESGKTILDYLI  DDGvskHYNRNFMQLINDSQL  714
WP_010818269  642  TQLSTFKGQFSAEVLKKLER-KHYTGWGRLSKKLINGIYDK  ESGKTILDYLI  DDGvskHYNRNFMQLINDSQL  714
WP_010824395  642  TQLSTFKGQFSAEVLKKLER-KHYTGWGRLSKKLINGIYDK  ESGKTILDYLI  DDGvskHYNRNFMQLINDSQL  714
WP_016622645  642  TQLSTFKGQFSAEVLKKLER-KHYTGWGRLSKKLINGIYDK  ESGKTILDYLI  DDGvskHYNRNFMQLINDSQL  714
WP_033624816  642  TQLSTFKGQFSAEVLKKLER-KHYTGWGRLSKKLINGIYDK  ESGKTILDYLI  DDGvskHYNRNFMQLINDSQL  714
WP_033625576  642  TQLSTFKGQFSAEVLKKLER-KHYTGWGRLSKKLINGIYDK  ESGKTILDYLI  DDGvskHYNRNFMQLINDSQL  714
WP_033789179  642  TQLSTFKGQFSEEVLKKLER-KHYTGWGRFSAKLINGIYDK  ESGKTILDYLI  DDGvskHYNRNFMQLINDSQL  714
WP_002310644  643  TRLSHHEATLGKHIIKKLTK-KHYTGWGRLSKELIQGIRDK  QSNKTILDYLI  DDDfphHRNRNFMQLINDDSL  715
WP_002312694  642  TRLSHHEATLGKHIIKKLTK-KHYTGWGRLSKELIQGIRDK  ESGKTILDYLI  DDDfphHRNRNFMQLINDDSL  714
WP_002314015  643  TRLSHHEATLGKHIIKKLTK-KHYTGWGRLSKELIQGIRDK  QSNKTILDYLI  DDDfphHRNRNFMQLINDDSL  715
WP_002320716  643  TRLSHHEATLGKHIIKKLTK-KHYTGWGRLSKELIQGIRDK  QSNKTILDYLI  DDDfphHRNRNFMQLINDDSL  715
WP_002330729  642  TRLSHHEATLGKHIIKKLTK-KHYTGWGRLSKELIQGIRDK  QSNKTILDYLI  DDDfphHRNRNFMQLINDDSL  714
WP_002335161  643  TRLSHHEATLGKHIIKKLTK-KHYTGWGRLSKELIQGIRDK  QSNKTILDYLI  DDDfphHRNRNFMQLINDDSL  715
WP_002345439  643  TRLSHHEATLGKHIIKKLTK-KHYTGWGRLSKELIQGIRDK  QSNKTILDYLI  DDDfphHRNRNCMQLINDDSL  715
WP_034867970  638  HQLSKYQEVFGEKLLKEFAR-KHYTGWGRFSAKLINGIRDR  KTNKTILDYLI  DDDvpaNRNRNLMQLINDEHL  710
WP_047937432  643  TRLSHHEATLGKHIIKKLTK-KHYTGWGRLSKELIQGIRDR  KTNKTILDYLI  DDDvpaNRNRNLMQLINDEHL  715
WP_010720994  638  HQLSKYQEVFGEKLLKEFAR-KHYTGWGRFSAKLINGIRDR  KTNKTILDYLI  DDDvpaNRNRNLMQLINDEHL  710
WP_010737004  638  HQLSKYQEVFGEKLLKEFAR-KHYTGWGRFSAKLINGIRDR  KTNKTILDYLI  DDDvpaNRNRNLMQLINDEHL  710
WP_034700478  638  HQLSKYQEVFGEKLLKEFAR-KHYTGWGRFSAKLINGIRDR  KTNKTILDYLI  DDDvpaNRNRNLMQLINDEHL  710
WP_007209003  635  NQLEQLPLNLSTKTIKALSR-RKYTGWGRLSARLIDGIHDK  NSGKTILDYLI  DESdsyIVNRNFMQLINDDHL  707
WP_023519017  632  EQLKPYETVLGLPAIKKLAK-KHYTGWGRLSEKMIQGMREK  QSRKTILDYLI  DDDfpcNRRNFMQLINDDHL   704
WP_010770040  635  EQLKKKYTYLFDEEVLKKLER-RHYTGWGRLSAKLIGIKEK  RTHKTILDYLI  DDGgkqPINRNLMQLINDSDL  707
WP_048604708  631  EQLSKFSDRLSEKTIKDLER-RHYTGWGRLSAKLINGIHDK  QSNKTILDYLI  DDApkkNINRNFMQLINDNRL  703
```

-continued

| | | | | | |
|---|---|---|---|---|---|
| WP_010750235 | 637 | TQLKKYQRILGEEIFKKLVK--KKYTGWGRLSRKLINGIRDQ | KTNKTILDYLI | DDDfpyNRRNFMQLINDDHL | 709 |
| AII16583 | 673 | ERLKTYAHLFDDKVMKQLKR--RRYTGWGRLSRKLINGIRDK | QSGKTILDFLK | -DGf----ANRNFMQLIHDDSL | 741 |
| WP_029073316 | 648 | RRLKKEYDLDEEKIKKILKL--KYSGWSRLSKKLLSGIKTK | RTPETVLEVME | ----TNMNLMQVINDEKL | 717 |
| WP_031589969 | 648 | RRLKKEYDLDEEKIKKILKL--KYSGWSRLSKKLLSGIKTK | RTPETVLEVME | ----TNMNLMQVINDEKL | 717 |
| KDA45870 | 631 | RRLENYRDFLGEDILRKLSR--KKYTGWGRLSAKLLDGIYDK | KTHKTILDCLM | EDYs----QNFMQLINDDTY | 698 |
| WP_039099354 | 651 | AKLNEIDWLTDQQRVQLAAK--RYRGWGRLSAKLLTQIVN- | ANGQRIMDLLM | ------TTDNFMRIVHSE-- | 712 |
| AKP02966 | 633 | EKLHSSNYSYTSDQIKKLSN-MRYKGWGRLSRKKILTCITTE | TNTPKSLQLSN | -DLm-wTTNNNFISIISNDKY | 706 |
| WP_010991369 | 638 | EQLQQFSDVLDGVVLKKLER-RHYTGWGRLSAKLLMGIRDK | QSHLTILDYLM | DDG----LNRNLMQLINDSNL | 706 |
| WP_033838504 | 638 | EQLQQFSDVLDGVVLKKLER-RHYTGWGRLSAKLLMGIRDK | QSHLTILDYLM | DDG----LNRNLMQLINDSNL | 706 |
| EHN60060 | 641 | EQLQQFSDVLDGVVLKKLER-RHYTGWGRLSAKLLMGIRDK | QSHLTILDYLM | DDG----LNRNLMQLINDSNL | 709 |
| EFR89594 | 407 | EQLQSFSDVLDGTILKKLER-RHYTGWGRLSAKLLTGIRDK | HSHLTILDYLM | DDG----LNRNLMQLINDSNL | 475 |
| WP_038409211 | 638 | EQLQSFSDVLDGTILKKLER-RHYTGWGRLSAKLLTGIRDK | HSHLTILDYLM | DDG----LNRNLMQLINDSNL | 706 |
| EFR95520 | 257 | EQLQSFSDVLDGTILKKLER-RHYTGWGRLSAKLLTGIRDK | HSHLTILDYLM | DDG----LNRNLMQLINDSNL | 325 |
| WP_003723650 | 638 | EQLQSFSDVLDGGVLKKLER-RHYTGWGRLSAKLLVGIREK | QSHLTILDYLM | DDG----LNRNLMQLINDSNL | 706 |
| WP_003727705 | 638 | EQLEQFSDVLDGVVLKKLER-RHYTGWGRLSAKLLVGIRDK | QSHLTILDYLM | DDG----LNRNLMQLINDSNL | 706 |
| WP_003730785 | 638 | EQLQQFSDVLDGVVLKKLER-RHYTGWGRLSAKLLVGIRDK | QSHLTILDYLM | DDG----LNRNLMQLINDSNL | 706 |
| WP_003733029 | 638 | EQLQQFSDVLDGTVLKKLER-RHYTGWGRLSAKLLVGIRDK | QSHLTILDYLM | DDG----LNRNLMQLINDSNL | 706 |
| WP_003739838 | 638 | EQLQQFSDVLDGAVLKKLER-RHYTGWGRLSAKLLVGIREK | QSHLTILDYLM | DDG----LNRNLMQLINDSNL | 706 |
| WP_014601172 | 638 | EQLQQFSDVLDGGVLKKLER-RHYTGWGRLSAKLLVGIREK | QSHLTILDYLM | DDG----LNRNLMQLINDSNL | 706 |
| WP_023548323 | 638 | EQLQQFSDVLDGTVLKKLER-RHYTGWGRLSAKLLVGIRDK | QSHLTILDYLM | DDG----LNRNLMQLINDSNL | 706 |
| WP_031665337 | 638 | EQLQQFSDVLDGVVLKKLER-RHYTGWGRLSAKLLVGIRDK | QSHLTILEYLM | DDG----LNRNLMQLINDSNL | 706 |
| WP_031669209 | 638 | EQLQQFSDVLDGTVLKKLER-RHYTGWGRLSAKLLVGIRDK | QSHLTILDYLM | DDG----LNRNLMQLINDSNL | 706 |
| WP_033920898 | 641 | EQLQQFSDVLDGGVLKKLER-RHYTGWGRLSAKLLVGIRDK | QSHLTILDYLM | DDG----LNRNLMQLINDSNL | 709 |
| AKI42028 | 638 | EQLQQFSDVLDGTVLKKLER-RHYTGWGRLSAKLLVGIREK | QSHLTILDYLM | DDG----LNRNLMQLINDSNL | 706 |
| AKI50529 | 86 | EQLQQFSDVLDGVVLKKLER-RHYTGWGRLSAKLLVGIREK | QSHLTILDYLM | DDG----LNRNLMQLINDSNL | 154 |
| EFR83390 | 638 | EQLQEFSNVLDEAVLKKLER-RHYTGWGRLSAKLLIGIREK | ESHLTILDYLM | DDK----HNRNLMQLINDSNL | 706 |
| WP_046323366 | 650 | ERLKTYAHLFDDKVMKQLKR--RRYTGWGRLSRKLINGIRDK | QSGKTILDFLK | -DGf----ANRNFMQLIHDDSL | 718 |
| AKE81011 | 642 | ERLKKYALPDDKIKQIIKL--KYKDWSRLSKKLLDGIVAD | SV--TVLDVLE | ----SRLNLMEIINDKEL | 709 |
| CU082355 | 645 | RRLKKKVYQLDDLLVDKILKL-NYTGWSRLSEKLLTGMTAD | KA--TVLFVLE | ----SNKNLMEIINDEKL | 712 |
| WP_033162887 | 667 | ERLKTYAHLFDDKVMKQLKR--RRYTGWGRLSRKLINGIRDK | QSGKTILDFLK | -DGf----ANRNFMQLIHDDSL | 735 |
| AGZ01981 | 634 | ERLKTYAHLFDDKVMKQLKR--RRYTGWGRLSRKLINGIRDK | QSGKTILDFLK | -DGf----ANRNFMQLIHDDSL | 702 |
| AKA60242 | 638 | ERLKTYAHLFDDKVMKQLKR--RRYTGWGRLSRKLINGIRDK | QSGKTILDFLK | -DGf----ANRNFMQLIHDDSL | 706 |
| AKS40380 | 638 | ERLKTYAHLFDDKVMKQLKR--RRYTGWGRLSRKLINGIRDK | QSGKTILDFLK | -DGf----ANRNFMQLIHDDSL | 706 |
| 4UN5_B | 638 | ERLKTYAHLFDDKVMKQLKR--RRYTGWGRLSRKLINGIRDK | QSGKTILDFLK | -DGf----ANRNFMQLIHDDSL | 706 |
| WP_010922251 | 703 | TFKEDIQKAQVSG-QGDS-LHEHIANLAGSPAIKKGILQTVKVVDELVKVMG-HKPENIVIEMARENQ | TTQKGQKNS | | 777 |
| WP_039695303 | 707 | PFKQIIQKSQVVG--DVDD-IEAVVHDLPGSPAIKKGILQSVKIKIVDELVKVMG-GNPDNIVIEMARENQ | TTNRGRSQS | | 780 |
| WP_045635197 | 702 | SFKEIIQKAQVIG-KTDD-VKQVVQELSGSPAIKKGILQSIKIKIVDELVKVMG-HAPESIVIEMARENQ | TTARGKKNS | | 775 |
| 5AXW_A | 427 | VPKKVDLSQQKEI---PT--TLVDDFILSPVVKRSFIQSIKVINAIIKKYG--LPNDIIIELAREKN | -------S | | 487 |
| WP_009880683 | 387 | TFKEDLQKAQVSG-QGDS-LHEHIANLAGSPAIKKGILQTVKVVDELVKVMGrHKPENIVIEMARENQ | TTQKGQKNS | | 461 |
| WP_010922251 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_010954416 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_011054388 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_011284745 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_011285506 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_011527619 | 703 | TFKEDIQKAQVSG-QGDS-LHEHIANLAGSPAIKKGILQTVKVVDELVKVMGrHKPENIVIEMARENQ | TTQKGQKNS | | 777 |
| WP_012560673 | 703 | TFKEDLQKAQVSG-QGHS-LHEHQIANLAGSPAIKKGILQTVKVVDELVKVMGrHKPENIVIEMARENQ | TTQKGQKNS | | 777 |
| WP_014407541 | 703 | TFKEDIQKAQVSG-QGHS-LHEHQIANLAGSPAIKKGILQTVKVVDELVKVMGrHKPENIVIEMARENQ | TTQKGQKNS | | 777 |
| WP_020905136 | 703 | TFKEAIQKAQVSG-QGDS-LHEHIANLAGSPAIKKGILQTVKVVDELVKVMG-HKPENIVIEMARENQ | TTQKGQKNS | | 776 |
| WP_023080005 | 703 | TFKEAIQKAQVSG-QGHS-LHEHQIANLAGSPAIKKGILQTVKVVDELVKVMG-HKPENIVIEMARENQ | TTQKGQKNS | | 777 |
| WP_023610282 | 703 | TFKEAIQKAQVSG-QGDS-LHEHIANLAGSPAIKKGILQTVKVVDELVKVMG-HKPENIVIEMARENQ | TTQKGQKNS | | 776 |
| WP_030125963 | 703 | TFKEDLQKAQVSG-QGDS-LHEHIANLAGSPAIKKGILQTVKVVDELVKVMG-HKPENIVIEMARENQ | TTQKGQKNS | | 777 |

| | | | |
|---|---|---|---|
| WP_030126706 | 703 | TFKEDIQKAQVSG-QGDS-LHEHIANLAGSPAIKKGILQTVKVVDELVKVMGrHKPENIVIEMARENQ | TTQKGQKNS | 777 |
| WP_031488318 | 703 | TFKEDIQKAQVSG-QGDS-LHEHIANLAGSPAIKKGILQTVKVVDELVKVMGrHKPENIVIEMARENQ | TTQKGQKNS | 777 |
| WP_032460140 | 703 | TFKEDLQKAQVSG-QGDS-LHEHIANLAGSPAIKKGILQTVKVVDELVKVMGrHKPENIVIEMARENQ | TTQKGQKNS | 777 |
| WP_032461047 | 703 | TFKEDIQKAQVSG-QGDS-LHEHIANLAGSPAIKKGILQTVKVVDELVKVMGrHKPENIVIEMARENQ | TTQKGQKNS | 777 |
| WP_032462016 | 703 | TFKEDIQKAQVSG-QGDS-LHEHIANLAGSPAIKKGILQTVKVVDELVKVMGrHKPENIVIEMARENQ | TTQKGQKNS | 777 |
| WP_032462936 | 703 | TFKEDIQKAQVSG-QGDS-LHEHIANLAGSPAIKKGILQTVKVVDELVKVMGrHKPENIVIEMARENQ | TTQKGQKNS | 777 |
| WP_032464890 | 703 | TFKEDIQKAQVSG-QGDS-LHEHIANLAGSPAIKKGILQTVKVVDELVKVMGrHKPENIVIEMARENQ | TTQKGQKNS | 777 |
| WP_033888930 | 528 | TFKEDIQKAQVSG-QGDS-LHEHIANLAGSPAIKKGILQTVKVVDELVKVMGrHKPENIVIEMARENQ | TTQKGQKNS | 602 |
| WP_038431314 | 703 | TFKEDIQKAQVSG-QGDS-LHEHIANLAGSPAIKKGILQTVKVVDELVKVMGrHKPENIVIEMARENQ | TTQKGQKNS | 777 |
| WP_038432938 | 703 | TFKEAIQKAQVSG-QGHS-LHEQIANLAGSPAIKKGILQTVKIVDELVKVMG-HKPENIVIEMARENQ | TTQKGQKNS | 776 |
| WP_038434062 | 703 | TFKEDIQKAQVSG-QGDS-LHEHIANLAGSPAIKKGILQTVKVVDELVKVMGrHKPENIVIEMARENQ | TTQKGQKNS | 777 |
| BAQ51233 | 614 | TFKEDIQKAQVSG-QGDS-LHEHIANLAGSPAIKKGILQTVKVVDELVKVMGrHKPENIVIEMARENQ | | 688 |
| KGE60162 | | | | |
| KGE60856 | | | | |
| WP_002989955 | 703 | TFKEDIQKAQVSG-QGDS-LHEHIANLAGSPAIKKGILQTVKVVDELVKVMG-HKPENIVIEMARENQ | TTQKGQKNS | 777 |
| WP_003030002 | 704 | SFKEEIARAQIIG-DVDD-IANVHDLPGSPAIKKGILQSVKIVDELVKVMG-HNPANIIIEMARENQ | MTDKGRMNS | 777 |
| WP_003065552 | 707 | PFKQIIQKSQVVG-DVDD-IEAVVHDLPGSPAIKKGILQSVKIVDELVKVMG-DNPDNIVIEMARENQ | TTNRGRSQS | 780 |
| WP_001040076 | 702 | SFKSIIDKARTGS-HSDN-LKEVIGELAGSPAIKKGILQSLKIVDELVKVMG-YEPEQIVVEMARENQ | TTAKGLSRS | 775 |
| WP_001040078 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040080 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040081 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040083 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040085 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040087 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040088 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040089 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040090 | 705 | SFKSIISKAQAGS-HSDN-LKEVVGELAGSPAIKKGILQSLKIVDELVKVVG-YEPEQIVVEMARENQ | TTNQGRRNS | 778 |
| WP_001040091 | 705 | SFKSIISKAQsGS-HSDN-LKEVVGELAGSPAIKKGILQSLKIVDELVKVMG-YEPEQIVVEMARENQ | TTNQGRRNS | 778 |
| WP_001040092 | 702 | SFKPIIDKARTGS-HLDN-LKEVVGELAGSPAIKKGILQSLKIVDELVKVMG-YEPEQIVVEMARENQ | TTAKGLSRS | 775 |
| WP_001040094 | 702 | SFKPIIDKARTGS-HLDN-LKEVVGELAGSPAIKKGILQSLKIVDELVKVMG-YEPEQIVVEMARENQ | TTAKGLSRS | 775 |
| WP_001040095 | 702 | SFKPIIDKARTGS-HSDN-LKEVVGELAGSPAIKKGILQSLKIVDELVKVMG-YEPEQIVVEMARENQ | TTAKGLSRL | 775 |
| WP_001040096 | 702 | SFKPIIDKARTGS-HSDN-LKEVVGELAGSPAIKKGILQSLKIVDELVKVMG-YEPEQIVVEMARENQ | TTAKGLSRS | 775 |
| WP_001040097 | 702 | SFKPIIDKARTGS-HSDN-LKEVVGELAGSPAIKKGILQSLKIVDELVKVMG-YEPEQIVVEMARENQ | TTAKGLSRS | 775 |
| WP_001040098 | 702 | SFKPIIDKARTGS-HSDN-LKEVVGELAGSPAIKKGILQSLKIVDELVKVMG-YEPEQIVVEMARENQ | TTAKGLSRS | 775 |
| WP_001040099 | 702 | SFKPIIDKARTGS-HSDN-LKEVVGELAGSPAIKKGILQSLKIVDELVKVMG-YEPEQIVVEMARENQ | TTAKGLSRS | 775 |
| WP_001040100 | 705 | SFKSIISKAQAGS-HSDN-LKEVVGELAGSPAIKKGILQSLKIVDELVKVMG-YEPEQIVVEMARENQ | TTNQGRRNS | 778 |
| WP_001040104 | 702 | SFKPIIDKAQAGS-HSDN-LKEVVGELAGSPAIKKGILQSLKIVDELVKVMG-YEPEQIVVEMARENQ | TTNQGRRNT | 778 |
| WP_001040105 | 705 | SFKSIISKAQAGS-HSDN-LKEVVGELAGSPAIKKGILQSLKIVDELVKVMG-YEPEQVVVEMARENQ | TTNQGRRNT | 778 |
| WP_001040106 | 705 | SFKPIIDKAQAGS-HSDN-LKEVVGELAGSPAIKKGILQSLKIVDELVKVMG-YEPEQIVVEMARENQ | TTNQGRRNT | 778 |
| WP_001040107 | 705 | SFKPIIDKAQAGS-HSDN-LKEVVGELAGSPAIKKGILQSLKIVDELVKVMG-YEPEQIVVEMARENQ | TTNQGRRNT | 778 |
| WP_001040108 | 705 | SFKPIIDKAQAGS-HSDN-LKEVVGELAGSPAIKKGILQSLKIVDELVKVMG-YEPEQIVVEMARENQ | TTNQGRRNT | 778 |
| WP_001040109 | 702 | SFKPIIDKAQAGS-HSDN-LKEVVGELAGSPAIKKGILQSLKIVDELVKVMG-YEPEQIVVEMARENQ | TTNQGRRNT | 775 |
| WP_001040110 | 705 | SFKPIIDKAQAGS-HSDN-LKEVVGELAGSPAIKKGILQSLKIVDELVKVMG-YEPEQIVVEMARENQ | TTNQGRRNT | 778 |
| WP_015058523 | 705 | SFKSIISKAQsGS-HSDN-LKEVVGELAGSPAIKKGILQSLKIVDELVKVMG-YEPEQIVVEMARENQ | TTNQGRRNS | 778 |
| WP_017643650 | 702 | SFKPIIDKAQAGS-HSDN-LKEVVGELAGSPAIKKGILQSLKIVDELVKVMG-YEPEQVVVEMARENQ | TTAKGLSRL | 775 |
| WP_017647151 | 705 | SFKSIISKAQAGS-HSDN-LKEVVGELAGSPAIKKGILQSLKIVDELVKVMG-YEPEQIVVEMARENQ | TTNQGRRNS | 778 |
| WP_017648376 | 705 | SFKSIISKAQAGS-HSDN-LKEVVGELAGSPAIKKGILQSLKIVDELVKVMG-YEPEQIVVEMARENQ | TTNQGRRNS | 778 |
| WP_017649527 | 705 | SFKSIISKAQAGS-HSDN-LKEVVGELAGSPAIKKGILQSLKIVDELVKVMG-YEPEQVVVEMARENQ | TTNQGRRNT | 778 |
| WP_017771611 | 705 | SFKPIIDKAQAGS-HSDN-LKEVVGELAGSPAIKKGILQSLKIVDELVKVMG-YEPEQVVVEMARENQ | TTNQGRRNT | 778 |
| WP_017771984 | 705 | SFKPIIDKAQAGS-HSDN-LKEVVGELAGSPAIKKGILQSLKIVDELVKVMG-YEPEQIVVEMARENQ | TTAKGLSRL | 775 |
| CFQ25032 | 705 | SFKSIISKAQAGS-HSDN-LKEVVGELAGSPAIKKGILQSLKIVDELVKVMG-YEPEQIVVEMARENQ | TTNQGRRNS | 778 |
| CFV16040 | 705 | SFKSIISKAQAGS-HSDN-LKEVVGELAGSPAIKKGILQSLKIVDELVKVMG-YEPEQIVVEMARENQ | TTNQGRRNS | 778 |
| KLJ37842 | 705 | SFKSIISKAQAGS-HSDN-LKEVVGELAGSPAIKKGILQSLKIVDELVKVMG-YEPEQIVVEMARENQ | TTNQGRRNS | 778 |

-continued

| | | | | |
|---|---|---|---|---|
| KLJ72361 | 705 | SFKSIISKAQAGS-HSDN-LKEVVGELAGSPAIKKGILQSLKIVDELVKVMG-YEPEQIVVEMARENQ | TTNQGRRNS | 778 |
| KLL20707 | 719 | SFKSIISKAQAGS-HSDN-LKEVVGELAGSPAIKKGILQSLKIVDELVKVMG-YEPEQIVVEMARENQ | TTNQGRRNS | 792 |
| KLL42645 | 705 | SFKPIIDKAQAGS-HSDN-LKEVVGELAGSPAIKKGILQSLKIVDELVKVMG-YEPEQVVVEMARENQ | TTNKGRRNT | 778 |
| WP_047207273 | 702 | SFKPIIDKARTGS-HSDN-LKEVVGELAGSPAIKKGILQSLKIVDELVKVMG-YEPEQIVVEMARENQ | TTAKGLSRS | 775 |
| WP_047209694 | 705 | SFKSIISKAQAGS-HSDN-LKEVVGELAGSPAIKKGILQSLKIVDELVKVMG-YEPEQIVVEMARENQ | TTNQGRRNS | 778 |
| WP_050198062 | 705 | SFKSIISKAQAGS-HSDN-LKEVVGELAGSPAIKKGILQSLKIVDELVKVMG-YEPEQIVVEMARENQ | TTNQGRRNS | 778 |
| WP_050201642 | 705 | SFKPIIDKAQAGS-HSDN-LKEVVGELAGSPAIKKGILQSLKIVDELVKVMG-YEPEQIVVEMARENQ | TTNQGRRNS | 778 |
| WP_050204027 | 705 | SFKPIIDKAQAGS-HSDN-LKEVVGELAGSPAIKKGILQSLKIVDELVKVMG-YEPEQVVVEMARENQ | TTNQGRRNT | 778 |
| WP_050881965 | 705 | SFKSIISKAQAGS-HSDN-LKEVVGELAGSPAIKKGILQSLKIVDELVKVMG-YEPEQIVVEMARENQ | TTNQGRRNS | 778 |
| WP_050886065 | 705 | SFKSIISKAQSGS-HSDN-LKEVVGELAGSPAIKKGILQSLKIVDELVKVMG-YEPEQIVVEMARENQ | TTNQGRRNS | 778 |
| AHN30376 | 705 | SFKSIISKAQAGS-HSDN-LKEVVSELAGSPAIKKGILQSLKIVDELVKVMG-YKPEQIVVEMARENQ | TTNQGRRNS | 778 |
| EA078426 | 705 | SFKSIISKAQAGS-HSDN-LKEVVGELAGSPAIKKGILQSVKIVDELVKVMG-HNPANIIIEMARENQ | TTDRGRRNS | 778 |
| CCW42055 | 704 | SFKEEIAKAQIIG-DVDD-IANVVHDLPGSPAIKKGILQSVKIVDELVKVMG-HNPANIIIEMARENQ | TTDKGRRNS | 777 |
| WP_003041502 | 705 | SFKEEIARAQIIG-DVDD-IANVVHDLPGSPAIKKGILQSLKIVDELVKVMG-HNPANIIIEMARENQ | TTDKGRRNS | 778 |
| WP_037593752 | 705 | SFKEEIARAQIIG-DVDD-IANVVHDLPGSPAIKKGILQSLKIVDELVKVMG-HNPANIIIEMARENQ | TTDKGRRNS | 778 |
| WP_049516684 | 705 | SFKEEIARAQIIG-DVDD-IANVVHDLPGSPAIKKGILQSLKIVDELVKVMG-HNPANIIIEMARENQ | TTDKGRRNS | 778 |
| GAD46167 | 704 | SFKEEIARAQIIG-DVDD-IANVVHDLPGSPAIKKGILQSLKIVDELVKVMG-HNPANIIIEMARENQ | TTDKGRRNS | 777 |
| WP_018363470 | 705 | SFKQIIQEAQVVG-DVDD-IETVVHDLPGSPAIKKGILQSVKIVDELIKVMG-DNPDNIVIEMARENQ | TTNRGRSQS | 778 |
| WP_003043819 | 713 | TFKEEIEKAQVSG-QGDS-LHEQIADLAGSPAIKKGISQTVKIVDELVKVMG-HKPENIVVEMARENQ | TTKGLQQS | 786 |
| WP_006269658 | 704 | SFKEEIARAQIID-DVDD-IANVVHDLPGSPAIKKGILQSVKIVDELVKVMG-HNPANIIIEMARENQ | TTDKGRRNS | 777 |
| WP_048800889 | 704 | PFKQIIKDAQAID-DVDD-IELIVHDLPGSPAIKKGILQSIKIVDELVKVMG-YNPDNIVIEMARENQ | TTTKGRRNS | 777 |
| WP_012767106 | 703 | TFKEAIQKAQVSG-QGHS-LHEQIANLAGSPAIKKGILQSVKIVDELVKVMG-HKPENIVIEMARENQ | TTQKGQKNS | 776 |
| WP_014612333 | 703 | TFKEAIQKAQVSG-QGHS-LHEQIANLAGSPAIKKGILQSVKIVDELVKVMG-HKPENIVIEMARENQ | TTQKGQKNS | 776 |
| WP_015017095 | 703 | TFKEAIQKAQVSG-QGHS-LHEQIANLAGSPAIKKGILQSVKIVDELVKVMG-HKPENIVIEMARENQ | TTQKGQKNS | 776 |
| WP_015057649 | 703 | SFKEAIQKAQVSG-QGHS-LHEQIANLAGSPAIKKGILQSVKIVDELVKVMG-HKPENIVIEMARENQ | TTQKGQKNS | 776 |
| WP_048272215 | 704 | TFKEAIQKAQVSG-QGHS-LHEQIANLAGSPAIKKGILQSVKIVDELVKVMG-HKPENIVIEMARENQ | TTQKGQKNS | 777 |
| WP_049519324 | 703 | TFKEAIQKAQVSG-QGHS-LHEQIANLAGSPAIKKGILQSVKVVDELVKVMG-HKPENIVIEMARENQ | TTQKGQKNS | 776 |
| WP_012515931 | 703 | SFIDEIAKAQVIG-KTEY-SKDLVGNLAGSPAIKKGISQTIKIVDELVKVMG-YLPQQIVIEMARENQ | TTAQGIKNA | 776 |
| WP_021320964 | 703 | SFIDEIAKAQVIG-KTEY-SKDLVGNLASSPAIKKGISQTIKIVDELVKIMG-YLPQQIVIEMARENQ | TTAQGIKNA | 776 |
| WP_037581760 | 703 | SFIDEIAKAQVIG-KTEY-SKDLVGNLAGSPAIKKGISQTIKIVDELVKIMG-YLPQQIVIEMARENQ | ITGYGRRNS | 776 |
| WP_042232481 | 704 | SFKTTIQKAQVIG-DVDD-IEAVVHDLPGSPAIKKGILQSVKIVDELVKVMG-HNPQNIVIEMARENQ | TTNRGRSQS | 777 |
| WP_009854540 | 705 | PFKQIIQKSQVVG-DIDD-VTSVVRELPGSPAIKKGILQSVKIVDELVKVMG-DNPDNIVIEMARENQ | TTNRGRRNS | 778 |
| WP_012962174 | 705 | PFKQIIKDAQIIG-DIDD-IEAVVHDLPGSPAIKKGILQSVKIVDELVKVMG-HNPDNIVIEMARENQ | TTNRGRNQS | 778 |
| WP_039695303 | 707 | PFKQIIQKSQVVG-DVDD-IEAVVHDLPGSPAIKKGILQSVKIVDELVKVMG-GNPDNIVIEMARENQ | TTNRGRSQS | 780 |
| WP_014334983 | 704 | SFKTIIQEAQVVG-DVDD-IEAVVHDLPGSPAIKKGILQSVKIVDELVKVMG-DNPDNIVIEMARENQ | TTGYGRNKS | 777 |
| WP_003099269 | 703 | DFAKIIKNEQEKTIKNES-LEETIANLAGSPAIKKGILQSIKIVDELVKIMG-QNPDNIVIEMARENQ | STMQGIKNS | 776 |
| AHY15608 | 703 | DFAKIIKNEQEKTIKNES-LEETIANLAGSPAIKKGILQSIKIVDEIVKIMG-QNPDNIVIEMARENQ | STMQGIKNS | 776 |
| AHY17476 | 703 | DFAKIIKNEQEKTIKNES-LEETIANLAGSPAIKKGILQSIKIVDEIVKIMG-QNPDNIVIEMARENQ | STMQGIKNS | 776 |
| ESR09100 | | | ------- | |
| AGM98575 | 703 | DFAKIIKNEQEKTIKNES-LEETIANLAGSPAIKKGILQSIKIVDEIVKIMG-QNPDNIVIEMARENQ | STMQGIKNS | 777 |
| ALF27331 | 704 | SFKEEIAKAQVIG-ETDN-LNQVVSDIAGSPAIKKGILQSLKIVDELVKIMG-YQPENIVVEMARENQ | FTNQGRRNS | 777 |
| WP_018372492 | 717 | DFKEIIRKAQTIE-NIDT-NQALVSSLPGSPAIKKGILQSLKIVDELVKIMG-YAPTNIVIEMARENQ | TTQKGRDNS | 790 |
| WP_045618028 | 703 | SFKEIIQKAQVVG-KTDN-VKQVVQELPGSPAIKKGILQSIKILVDELVKVMG-HAPESIVIEMARENQ | TTARGKKNS | 776 |
| WP_045635197 | 702 | SFKEIIQKAQVIG-KTDD-VKQVVQELSGSPAIKKGILQSIKIVDELVKVMG-HAPESIVIEMARENQ | TTARGKKNS | 775 |
| WP_002263549 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002263887 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002264920 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002269043 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002269448 | 704 | SFKEEIAKAQVIG-ETDN-LNQVVSDIAGSPAIKKGILQSLKIVDELVKIMG-HQPENIVVEMARENQ | FTNQGRQNS | 777 |
| WP_002271977 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002272766 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002273241 | 704 | SFKEEIAKAQVIG-ETDN-LNQVVSDIAGSPAIKKGILQSLKIVDELVKIMG-HQPENIVVEMARENQ | FTKQGRRNS | 777 |
| WP_002275430 | 704 | SFKEEIAKAQVIG-ETDN-LNQVVSDIAGSPAIKKGILQSLKIVDELVKIMG-HQPENIVVEMARENQ | FTNQGRRNS | 777 |

| | | | |
|---|---|---|---|
| WP_002276448 | 704 | SFKEEIAKAQVIG-ETDN-LNQVVSDIAGSPAIKKGILQSLKIVDELVKIMG-HQPENIVVEMARENQ | FTKQGRRNS | 777 |
| WP_002277050 | 705 | TFKDDIVKAQYVD-NSDD-LHQVVQSLAGSPAIKKGILQSLKIVDELVKIMG-KEPEQIVVEMARENQ | TTAKGRRNS | 778 |
| WP_002277364 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002279025 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002279859 | 704 | SFKEEIAKAQVIG-ETDN-LNQVVSDIAGSPAIKKGILQSLKIVDELVKIMG-HQPENIVVEMARENQ | FTKQGRRNS | 777 |
| WP_002280230 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002281696 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002282247 | 705 | TFKDDIVKAQYVD-NSDD-LHQVVQSLAGSPAIKKGILQSLKIVDELVKVMG-KEPEQIVVEMARENQ | TTAKGRRNS | 778 |
| WP_002282906 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002283846 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002287255 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002288990 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002289641 | 704 | SFKEEIAKAQVIG-ETDN-LNQVVSDIAGSLAGSLAIKKGILQSLKIVDELVKIMG-HQPENIVVEMARENQ | FTNQGRRNS | 777 |
| WP_002290427 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002295753 | 704 | SFKEEIAKAQVIG-ETDN-LNQVVSDIAGSPAIKKGILQSLKIVDELVKIMG-HQPENIVVEMARENQ | FTKQGRRNS | 777 |
| WP_002296423 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_002304487 | 714 | SFKEEIAKAQVIG-EMDG-LNQVVSDIAGSPAIKKGILQSLKIVDELVKIMG-HNPANIVIEMARENQ | TTAKGRRSS | 787 |
| WP_002305844 | 704 | SFKEEIAKAQVIG-ETDN-LNQVVSDIAGSPAIKKGILQSLKIVDELVKIMG-HQPENIVVEMARENQ | FTKQGRRNS | 777 |
| WP_002307203 | 704 | SFKEEIAKAQVIG-ETDN-LNQVVSDIAGSPAIKKGILQSLKIVDELVKIMG-HQPEQIVVEMARENQ | FTNQGRRNS | 777 |
| WP_002310390 | 704 | SFKEEIAKAQVIG-ETDN-LNQVVSDIAGSLAIKKGILQSLKIVDELVKIMG-HQPENIVVEMARENQ | FTNQGRRNS | 777 |
| WP_002352408 | 704 | SFKEEIAKAQVIG-ETDN-LNQVVSDIAGSPAIKKGILQNLKIVDELVKIMG-HQPENIVVEMARENQ | FTNQGQRNS | 777 |
| WP_012997688 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_014677909 | 705 | TFKDDIVKAQYVD-NSDD-LHQVVQSLAGSPAIKKGILQSLKIVDELVKIMG-KEPEQIVVEMARENQ | TTAKGRRNS | 778 |
| WP_019312892 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_019313659 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_019314093 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_019315370 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_019803776 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_019805234 | 704 | SFKEEIAKAQVIG-ETDN-LNQVVSDIAGSLAIKKGILQSLKIVDELVKIMG-HQPENIVVEMARENQ | FTNQGRRNS | 777 |
| WP_024783594 | 704 | SFKEEIAKAQVIG-ETDN-LNQVVSDIAGSPAIKKGILQSLKIVDELVKIMG-HQPENIVVEMARENQ | TTAKGRRNS | 777 |
| WP_024784288 | 705 | TFKDDIVKAQYVD-NSDD-LHQVVQSLAGSPAIKKGILQSLKIVDELVKIMG-KEPEQIVVEMARENQ | TTAKGRRNS | 778 |
| WP_024784666 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_024784894 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_024786433 | 705 | TFKDDIVKAQYVD-NSDD-LHQVVQSLAGSPAIKKGILQSLKIVDELVKIMG-KEPEQIVVEMARENQ | TTAKGRRNS | 778 |
| WP_049473442 | 704 | SFKEEIAKAQVIG-ETDN-LNQVVSDIAGSPAIKKGILQSLKIVDELVKIMG-HQPENIVVEMARENQ | FTNQGRRNS | 777 |
| WP_049474547 | 704 | SFKEEIAKAQVIG-ETDN-LNQVVSDIAGSPAIKKGILQSLKIVDELVKIMG-HQPENIVVEMARENQ | FTNQGRRNS | 777 |
| EMC03581 | 697 | SFKEEIAKAQEGG-LKDS-INDQIRDLAGSPAIKKGILQTNIVDEIVKIMG-KAPQHIVVEMARDVQ | TTAKGRRNS | 770 |
| WP_000428612 | 705 | SFKEIIKKAQVVG-KTDD-VKQVVQELPGSPAIKKGILQSIKIVDELVKIMG-HEPESIVIEMARENQ | TTARGKKNS | 778 |
| WP_000428613 | 703 | SFKETIQKAQVVG-KTDD-VKQVVQELPGSAIKKGILQSIKIVDELVKVMG-HTPESIVIEMARENQ | TTARGKKNS | 776 |
| WP_049523028 | 702 | SFKEIIQKAQVVG-ETND-VKQVVQEIPGSPAIKKGILQSIKIVDELVKVMG-HAPESVVIEMARENQ | TTNKGKSKS | 775 |
| WP_003107102 | 672 | DFASIIKKAQEKTIKSEK-LEETIANLAGSPAIKKGILQSVKIVDEVVKVMG-YEPESVIEMARENQ | STQRGINNS | 746 |
| WP_054279288 | 705 | SFKEEIKKAQEGG-LKDS-INDQIRDLAGSPAIKKGILQTNIVDEIVKIMG-KAPQHIVVEMARDVQ | KTDIGVKQS | 778 |
| WP_049531101 | 703 | SFKEIIQESQVVG-KPDD-VKQIVVQELPGSSAIKKGILQSILVDELVKIMG-HDPESIVIEMARENQ | TTARGKKNS | 776 |
| WP_049538452 | 703 | SFKEIIQKAQVFG-KTND-VKQVVQELPGSPAIKKGILQSIKIVEELVKVMG-HEPESIVIEMARENQ | TTTRGKKNS | 776 |
| WP_049549711 | 703 | SFKKIIQKSQVVG-ETDD-VKQVRELPGSPAIKKGILQSIKIVDELVKVMD-HAPESIVIEMARENQ | TTARGKKNS | 776 |
| WP_007896501 | 706 | DFEKLIDDAQKKAIKRES-LTEAVANLAGSPAIKKGILQSLKVVDEIVKVMG-HNPDNIVIEMSRENQ | TTAQGLKNA | 780 |
| EFR44625 | 658 | DFEKLIDDAQKKAIKRES-LTEAVANLAGSPAIKKGILQSLKVVDEIVKVMG-HNPDNIVIEMSRENQ | TTAQGLKNA | 732 |
| WP_002897477 | 702 | SFKDEIANSQVIG-DGDD-LHQVVQVVQELPGSPAIKKGILQSLKIVDELVKVMG-YALESIVIEMARENQ | TTARGKKNS | 775 |
| WP_002906454 | 702 | SFKEIIQKAQVFG-KTND-VKQVVQEIPGSPAIKKGILQSIKIVDELVKVMG-HNPESIVIEMARENQ | TTARGKKNS | 775 |
| WP_009729476 | 706 | SFKEIIQKAQVVG-KTND-VKQVVQELPGSPAIKKGILQSIKIVDELVKVMG-HAPESIVIEMARENQ | TTARGKKNS | 779 |
| CQR24647 | 705 | SFKEIIQKAQVFG-KTND-VKQVVQEIPGSPAIKKGILQSIKIVDELVKVMG-YNPEQIVVEMARENQ | TTARGKKNS | 778 |
| WP_000066813 | 705 | SFKKIIQKSQVVG-ETDD-VKQVVQELPGSPAIKKGILQSIKIVDELVKVMG-HAPESIVIEMARENQ | TTARGKKNS | 778 |
| WP_009754323 | 703 | SFKEIIQKAQVVG-KTDD-LTQVVRELSGSPAIKKGILQSIKIVDELVKIMG-YAPESIVIEMARENQ | TTAKGKKNS | 776 |

| | | | | |
|---|---|---|---|---|
| WP_044674937 | 702 | SFVDEIRLAQGSG-EAED-YRAEVQNLAGSPAIKKGILQSLKIVDELIEVMG-YDPEHIVVEMARENQ | FTNQGRRNS | 775 |
| WP_044676715 | 704 | SFVDEIRLAQGSG-EAED-YRAEVQNLAGSPAIKKGILQSLKIVDELIEVMG-YDPEHIVVEMARENQ | FTNQGRRNS | 777 |
| WP_044680361 | 704 | SFVDEIRLAQGSG-EAED-YRAEVQNLAGSPAIKKGILQSLKIVDELIEVMG-YDPEHIVVEMARENQ | FTNQGRRNS | 777 |
| WP_044681799 | 702 | SFVDEIRLAQGSG-EAED-YRAEVQNLAGSPAIKKGILQSLKIVDELIEVMG-YDPEHIVVEMARENQ | FTNQGRRNS | 775 |
| WP_049533112 | 704 | SFKEEIAKQVIG-ETDD-LNQVVSDIAGSPAIKKGILQSLKIVDELVKVMG-YNPANIVIEMARENQ | TTDKGRRNS | 777 |
| WP_029090905 | 683 | LFKKIIEEQFENEtALLN--KQRIDELAASPANKKGIWQAIKIVKELEKVLQ-QPAENIFIEFARSDE | ES----KRS | 752 |
| WP_006506696 | 706 | GYAQMIEEATSCPeDGKF-TYEEVERLAGSPALKRGIWQSLQIVEEITKVMK-CRPKYIYIEFERSEE | ----KERT | 776 |
| AIT42264 | 703 | TFKEDIQKAQVSG-QGDS-LHEHIANLAGSPAIKKGIIQTVKVVDELIKIVMG-HKPENIVIEMARENQ | TTQKGQKNS | 777 |
| WP_034440723 | 711 | SEKEKIRKAQDIN-QVND-IKEIVKDLPGSPAIKKGIYQSIRIVDEIIRKMK-DRPKNIVIEMARENQ | TTQEGKNKS | 784 |
| AKQ21048 | 703 | TFKEDIQKAQVSG-QGDS-LHEHIANLAGSPAIKKGILQTVKVVDELVKVMG-HKPENIVIEMARESQ | TTQKGQKNS | 777 |
| WP_044636532 | 707 | SFKKIEDAQTIE-DTTH-IYDTVAELPGSPAIKKGIRQALKIVEEIIDIIG-YEPENIVIEMARENQ | TTKKGKDLS | 780 |
| WP_002364836 | 715 | SEKNAIQKAQSSE-HEET-LSETVNELAGSPAIKKGIYQSLKIVDELVAIMG-YAPKRIVVEMARENQ | TTSTGKRRS | 788 |
| WP_016631044 | 666 | SEKNAIQKAQSSE-HEET-LSETVNELAGSPAIKKGIIQSLKIVDELIEVMG-YAPKRIVVEMARENQ | TTSTGKRRS | 739 |
| EMS75795 | 455 | SFKEELANELALA-GNQS-LLEVVEALLGSPAIKKGIWQTLKIVEELIEIIG-YNPKNIVIEMARENQ | RT----NRS | 524 |
| WP_002373311 | 715 | SEKNAIQKAQSSE-HEET-LSETVNELAGSPAIKKGIYQSLKIVDELVAIMG-YAPKRIVVEMARENQ | TTSTGKRRS | 788 |
| WP_002378009 | 715 | SEKNAIQKAQSSE-HEET-LSETVNELAGSPAIKKGIYQSLKIVDELVAIMG-YAPKRIVVEMARENQ | TTSTGKRRS | 788 |
| WP_002407324 | 715 | SEKNAIQKAQSSE-HEET-LSETVNELAGSPAIKKGIYQSLKIVDELVAIMG-YAPKRIVVEMARENQ | TTSTGKRRS | 788 |
| WP_002413717 | 717 | SEKNAIQKAQSSE-HEET-LSETVNELAGSPAIKKGIYQSLKIVDELVAIMG-YAPKRIVVEMARENQ | TTSTGKRRS | 790 |
| WP_010775580 | 715 | SEKNAIQKAQSSE-HEET-LSETVNELAGSPAIKKGIYQSLKIVDELVAIMG-YAPKRIVVEMARENQ | TTSTGKRRS | 788 |
| WP_010818269 | 715 | SEKNAIQKAQSSE-HEET-LSETVNELAGSPAIKKGIYQSLKIVDELVAIMG-YAPKRIVVEMARENQ | TTSTGKRRS | 788 |
| WP_010824395 | 715 | SEKNAIQKAQSSE-HEET-LSETVNELAGSPAIKKGIYQSLKIVDELVAIMG-YAPKRIVVEMARENQ | TTSTGKRRS | 788 |
| WP_016622645 | 715 | SEKNAIQKAQSSE-HEET-LSETVNELAGSPAIKKGIYQSLKIVDELVAIMG-YAPKRIVVEMARENQ | TTSTGKRRS | 788 |
| WP_033624816 | 715 | SEKNAIQKAQSSE-HEET-LSETVNELAGSPAIKKGIYQSLKIVDELVAIMG-YAPKRIVVEMARENQ | TTSTGKRRS | 788 |
| WP_002625576 | 715 | SEKNAIQKAQSSE-HEET-LSETVNELAGSPAIKKGIYQSLKIVDELVAIMG-YAPKRIVVEMARENQ | TTSTGKRRS | 788 |
| WP_033789179 | 715 | SEKNAIQKAQSSE-HEET-LSETVNELAGSPAIKKGIYQSLKIVDELVAIMG-YAPKRIVVEMARENQ | TTSTGKRRS | 788 |
| WP_002310644 | 715 | SFKKEIKKAQMIT-DTEN-LEEIVKELTGSPAIKKGILQSLKIVDELVGIMG-YEPANIVVEMARENQ | TTGRGLKSS | 788 |
| WP_002312694 | 716 | SFKKEIKKAQMIT-DTEN-LEEIVKELTGSPAIKKGILQSLKIVDELVGIMG-YEPANIVVEMARENQ | TTGRGLKSS | 789 |
| WP_002314015 | 716 | SFKKEIKKAQMIT-DTEN-LEEIVKELTGSPAIKKGILQSLKIVDELVGIMG-YEPANIVVEMARENQ | TTGRGLKSS | 789 |
| WP_002320716 | 716 | SFKKEIKKAQMIT-DTEN-LEEIVKELTGSPAIKKGILQSLKIVDELVGIMG-YEPANIVVEMARENQ | TTGRGLKSS | 789 |
| WP_002330729 | 715 | SFKKEIKKAQMIT-DTEN-LEEIVKELTGSPAIKKGILQSLKIVDELVGIMG-YEPANIVVEMARENQ | TTGRGLKSS | 788 |
| WP_002345439 | 716 | SFKKEIKKAQMIT-DTEN-LEEIVKELTGSPAIKKGILQSLKIVDELVGIMG-YEPANIVVEMARENQ | TTGRGLKSS | 789 |
| WP_002351161 | 716 | SFKKEIAKATVFS-KHKS-LVDVIQDLPGSPAIKKGIWQSLKIVEELIAIIG-YKPKNIVIEMARENQ | TTGRGLKSS | 789 |
| WP_034867970 | 711 | SFKKEIAKATVFS-KHKS-LVDVIQDLPGSPAIKKGIWQSLKIVEELIAIIG-YKPKNIVIEMARENQ | KT---HRT | 780 |
| WP_047937432 | 716 | SFKEEIAKATVFS-KHKS-LVDVIQDLPGSPAIKKGIWQSLKIVEELIAIIG-YKPKNIVIEMARENQ | TTGRGLKSS | 789 |
| WP_010720994 | 711 | SFKEEIAKATVFS-KHKS-LVDVIQDLPGSPAIKKGIWQSLKIVEELIAIIG-YKPKNIVIEMARENQ | KT---HRT | 780 |
| WP_010737004 | 711 | SFKEEIAKATVFS-KHKS-LVDVIQDLPGSPAIKKGIWQSLKIVEELIAIIG-YKPKNIVIEMARENQ | KT---HRT | 780 |
| WP_034700478 | 711 | SFKEEIAKATVFS-KHKS-LVDVIQDLPGSPAIKKGIWQSLKIVEELIAIIG-YKPKNIVIEMARENQ | KT---HRT | 780 |
| WP_007209003 | 708 | SFKKIIEDSQPYK-EQQS-AEEIVSELSGSPAIKKGILQSLEIVDELVAIMG-YKPKSIVVEMARETQ | TTGRGKQNS | 781 |
| WP_023519017 | 705 | SFKETIANELIMS-DSNV-LLDQVKAIPGSPAVKKGIWQSIKIVEEIIGIIG-KAPKNIVIEMARENQ | RTSR----S | 774 |
| WP_010770040 | 708 | SFSEIAEAQSDM-NTED-LHEVVQNLAGSPAIKKGIWQSLKIVDELVDIMG-SLPKNIVVEMARENQ | TTSRGRTNS | 781 |
| WP_048604708 | 704 | TFKEEIEKQLKA-NSEEsLIEIVEQNLAGSPAIKKGIPQSLKIVEIMG-YAPKNIVIEMARENQ | TTANGRRNS | 778 |
| WP_010750235 | 710 | SFKEEIAKELTLS-DKQS-LLEVVEAIPGSPAIKKGIWQTLKIVEELIAIIG-YKPKNIVIEMARENQ | TTGGKNRS | 783 |
| AII6583 | 742 | TFKEDIQKAQVSG-QGDS-LHEHIANLAGSPAIKKGILQTVKVVDELVKVMGrHKPENIVIEMARENQ | TTQKGQKNS | 816 |
| WP_029073316 | 718 | GFKKTIDDANSTSvSGKF-SYAEVQELAGSPAIKRGIWQALLIVDEIKKIMK-HEPAHVYIEFARNED | ----KERK | 788 |
| WP_031589969 | 718 | GFKKTIDDANSTSvSGKF-SYAEVQELAGSPAIKRGIWQALLIVDEIKKIMK-HEPAHVYIEFARNED | ----KERK | 788 |
| KDA45870 | 699 | SFKETIKNAQVIE-KEET-LAKTVQELPGSPAIKKGIIQSLEIVDEIIKVMG-YKPKSIVEMARETQ | --THGTRKR | 771 |
| WP_039099354 | 713 | DPDKLITEANQMM-LAENgVQDVINDLYTSPQNKKALRQILLVVNDIQKAMKgQAPERILIEFAREDE | VNPRLSVQR | 788 |
| AKP02966 | 707 | DFKNYIENHNLNKnEDQN-ISNLVNDIHVSPALKRGTTQSIKIVQEVIVKFPMG-HAPKYIFIEVTRETK | TTSRGKRIQ | 785 |
| WP_010991369 | 707 | SFKSIIEKEQVTT-ADKD-IQSIVADLAGSPAIKKGILQSLKIVDELVSVMG-YPPQTIVVEMARENQ | TTGKGKNNS | 780 |
| WP_033838504 | 710 | SFKSIIEKEQVTT-ADKD-IQSIVADLAGSPAIKKGILQSLKIVDELVSVMG-YPPQTIVVEMARENQ | TTGKGKNNS | 783 |
| EHN60060 | 476 | SFKSIIEKEQVTT-ADKD-IQSIVADLAGSPAIKKGILQSLKIVDELVSVMG-YPPQTIVVEMARENQ | TTGKGKNNS | 549 |
| EFR89594 | | | | |
| WP_038409211 | 707 | SFKSIIEKEQVST-ADKG-IQSIVAELAGSPAIKKGILQSLKIVDELVGIMG-YPPQTIVVEMARENQ | TTGKGKNNS | 780 |

-continued

| ID | col1 | n1 | col2 | col3 | col4 | n2 |
|---|---|---|---|---|---|---|
| EFR95520 | 326 | SFKSIIEKEQVST-ADKG-IQSIVAELAGSPAIKKGILQSLKIVDELVGIMG- | YPPQTIVVEMARENQ | TTGKGKNNS | 399 |
| WP_003723650 | 707 | SFKSIIEKEQVST-TDKD-LQSIVAELAGSPAIKKGILQSLKIVDELVSIMG- | YPPQTIVVEMARENQ | TTGKGKNNS | 780 |
| WP_003727705 | 707 | SFKSIIEKEQVST-TDKD-LQSIVADLAGSPAIKKGILQSLKIVDELVSIMG- | YPPQTIVVEMARENQ | TTGKGKNNS | 780 |
| WP_003730785 | 707 | SFKSIIEKEQVST-TDKD-LQSIVADLAGSPAIKKGILQSLKIVDELVSIMG- | YPPQTIVVEMARENQ | TTGKGKNNS | 780 |
| WP_003733029 | 707 | SFKSIIEKEQVST-TDKD-LQSIVAELAGSPAIKKGILQSLKIVDELVSIMG- | YPPQTIVVEMARENQ | TTNKGKNNS | 780 |
| WP_003739838 | 707 | SFKSIIEKEQVST-TDKD-LQSIVADLAGSPAIKKGILQSLKIVDELVSIMG- | YPPQTIVVEMARENQ | TTGKGKNNS | 780 |
| WP_014601172 | 707 | SFKSIIEKEQVST-TDKD-LQSIVADLAGSPAIKKGILQSLKIVDELVSIMG- | YPPQTIVVEMARENQ | TTGKGKNNS | 780 |
| WP_023548323 | 707 | SFKSIIEKEQVST-ADKD-LQSIVADLAGSPAIKKGILQSLKIVDELVSIMG- | YPPQTIVVEMARENQ | TTGKGKNNS | 780 |
| WP_031665337 | 707 | SFKSIIEKEQVST-TDKD-LQSIVAELAGSPAIKKGILQSLKIVDELVSIMG- | YPPQTIVVEMARENQ | TTGKGKNNS | 780 |
| WP_031669209 | 707 | SFKSIIEKEQVST-ADKD-LQSIVADLAGSPAIKKGILQSLKVVEELVSVMG- | YPPQTIVVEMARENQ | TTNKGKNNS | 780 |
| WP_033920898 | 707 | SFKSIIEKEQVST-ADKD-LQSIVADLAGSPAIKKGILQSLKIVDELVSIMG- | YPPQTIVVEMARENQ | TTNKGKNNS | 780 |
| AKI42028 | 710 | SFKSIIEKEQVST-TDKD-LQSIVADLAGSPAIKKGILQSLKIVDELVSIMG- | YPPQTIVVEMARENQ | TTGKGKNNS | 783 |
| AKI50529 | 710 | SFKSIIEKEQVST-TDKD-LQSIVADLAGSPAIKKGILQSLKVVEELVSVMG- | YPPQTIVVEMARENQ | TTNKGKNNS | 783 |
| EFR83390 | 155 | SFKSIIEKEQVST-ADKD-IQSIVADLAGSPAIKKGILQSLKIVDELVGIMG- | YPPQTIVVEMARENQ | TTGKGKNNS | 228 |
| WP_046323366 | 707 | SFKSIIEKEQVST-ADKD-LQSIVADLAGSPAIKKGILQSLKIVDELVSIMG- | YPPQTIVVEMARENQ | TTGKGKNNS | 780 |
| AKE81011 | 719 | TFKEDIQKAQVSG-QGDS-LHEHIANLAGSPALKKGILQTVKVVMGrHKPENIVIEMARENQ | | TTQKGQKNS | 793 |
| CU082355 | 710 | GYAQMIEEASSCPkDGKF-TYEEVAKLAGSPALKRGIWQSLQIVEEITKVMK- | CRPKYIYIEPERSEE | ----- | 780 |
| WP_033162887 | 713 | GYKQIIEESNMQDiEGPF-KYDEVKKLAGSPAIKRGIWQALLVVREITKFMK- | HEPSHIYIEFAREEQ | ----KERT | 783 |
| AGZ01981 | 736 | TFKEDIQKAQVSG-QGDS-LHEHIANLAGSPAIKKGILQTVKVVDELVKVMGrHKPENIVIEMARENQ | | ----KVRK | 810 |
| AKA60242 | 703 | TFKEDIQKAQVSG-QGDS-LHEHIANLAGSPAIKKGILQTVKVVDELVKVMGrHKPENIVIEMARENQ | | TTQKGQKNS | 777 |
| AKS40380 | 703 | TFKEDIQKAQVSG-QGDS-LHEHIANLAGSPAIKKGILQTVKVVDELVKVMGrHKPENIVIEMARENQ | | TTQKGQKNS | 777 |
| 4UN5_B | 707 | TFKEDIQKAQVSG-QGDS-LHEHIANLAGSPAIKKGILQTVKVVDELVKVMGrHKPENIVIEMARENQ | | TTQKGQKNS | 781 |

| ID | col1 | n1 | col2 | col3 | col4 | col5 | n2 |
|---|---|---|---|---|---|---|---|
| WP_010922251 | 778 | RERMKRIEEGIK | ELGS | QIILKEHP--VE---NTQLQNEKLYLYYLQNGRDMYVDQEL--D---INRLSDYDVDH[I] | 841 |
| WP_039969303 | 781 | QQRLKKLQNSLK | PSYI | E---DK--VE---NSHLQNDQLFLYYIQNGDEL-MYTGDEL-D--IDHLSDYDIDHI | 851 |
| WP_045635197 | 776 | QQRYKRIEDSLK | ILAS | NILKENP--TD---NNQLQNDRLFLYYLQNGKDMYTGEAL--D--INQLSSYDIDHI | 843 |
| 5AXW_A | 488 | KDAQKMINEMQK | QTNE | EIIRTTGk--E---NAKYLIEKIKLHDMQEGKCLYSLEAIpIEdILNNPFNYEVDHI | 561 |
| WP_009880683 | 462 | RERMKRIEEGIK | ELGS | DIILKEYP--VE---NTQLQNEKLYLYYLQNGRDMYVDQEL--D--INRLSDYDVDHI | 525 |
| WP_010922251 | 778 | RERMKRIEEGIK | ELGS | QIILKEHP--VE---NTQLQNEKLYLYYLQNGRDMYVDQEL--D--INRLSDYDVDHI | 841 |
| WP_011054416 | 778 | RERMKRIEEGIK | ELGS | DIILKEYP--VE---NTQLQNEKLYLYYLQNGRDMYVDQEL--D--INRLSDYDVDHI | 841 |
| WP_011284745 | 778 | RERMKRIEEGIK | ELGS | QIILKEHP--VE---NTQLQNEKLYLYYLQNGRDMYVDQEL--D--INRLSDYDVDHI | 841 |
| WP_011285506 | 778 | RERMKRIEEGIK | ELGS | QIILKEHP--VE---NTQLQNEKLYLYYLQNGRDMYVDQEL--D--INRLSDYDVDHI | 841 |
| WP_011527619 | 778 | RERMKRIEEGIK | ELGS | QIILKEHP--VE---NTQLQNEKLYLYYLQNGRDMYVDQEL--D--INRLSDYDVDHI | 841 |
| WP_012560673 | 778 | RERMKRIEEGIK | ELGS | DIILKEYP--VE---TTQLQNEKLYLYYLQNGRDMYVDQEL--D--INRLSDYDVDHI | 841 |
| WP_014407541 | 777 | RERMKRIEEGIK | ELGS | QIILKEHP--VE---NTQLQNEKLYLYYLQNGRDMYVDQEL--D--INRLSDYDVDHI | 840 |
| WP_020905136 | 778 | RERMKRIEEGIK | ELGS | QIILKEHP--VE---NTQLQNEKLYLYYLQNGRDMYVDQEL--D--INRLSDYDVDHI | 841 |
| WP_023080005 | 777 | RERMKRIEEGIK | ELGS | QIILKEYP--VE---NTQLQNEKLYLYYLQNGRDMYVDQEL--D--INRLSDYDVDHI | 840 |
| WP_023610282 | 777 | RERMKRIEEGIK | ELGS | DIILKEYP--VE---NTQLQNEKLYLYYLQNGRDMYVDQEL--D--INRLSDYDVDHI | 840 |
| WP_030125963 | 778 | RERMKRIEEGIK | ELGS | QIILKEHP--VE---NTQLQNEKLYLYYLQNGRDMYVDQEL--D--INRLSDYDVDHI | 841 |
| WP_030126706 | 778 | RERMKRIEEGIK | ELGS | DIILKEYP--VE---NTQLQNEKLYLYYLQNGRDMYVDQEL--D--INRLSDYDVDHI | 841 |
| WP_031488318 | 778 | RERMKRIEEGIK | ELGS | DIILKEYP--VE---NTQLQNEKLYLYYLQNGRDMYVDQEL--D--INRLSDYDVDHI | 841 |
| WP_032460140 | 778 | RERMKRIEEGIK | ELGS | QIILKEHP--VE---NTQLQNEKLYLYYLQNGRDMYVDQEL--D--INRLSDYDVDHI | 841 |
| WP_032461047 | 603 | RERMKRIEEGIK | ELGS | QIILKEHP--VE---NTQLQNEKLYLYYLQNGRDMYVDQEL--D--INRLSDYDVDHI | 666 |
| WP_032462016 | 778 | RERMKRIEEGIK | ELGS | QIILKEHP--VE---NTQLQNEKLYLYYLQNGRDMYVDQEL--D--INRLSDYDVDHI | 841 |
| WP_032462936 | 778 | RERMKRIEEGIK | ELGS | DIILKEYP--VE---NTQLQNEKLYLYYLQNGRDMYVDQEL--D--INRLSDYDVDHI | 841 |
| WP_032464890 | 778 | RERMKRIEEGIK | ELGS | DIILKEYP--VE---NTQLQNEKLYLYYLQNGRDMYVDQEL--D--INRLSDYDVDHI | 841 |
| WP_033888930 | 778 | RERMKRIEEGIK | ELGS | QIILKEHP--VE---NTQLQNEKLYLYYLQNGRDMYVDQEL--D--INRLSDYDVDHI | 841 |
| WP_038431314 | 778 | RERMKRIEEGIK | ELGS | DIILKEYP--VE---NTQLQNEKLYLYYLQNGRDMYVDQEL--D--INRLSDYDVDHI | 841 |
| WP_038432938 | 777 | RERMKRIEEGIK | ELGS | DIILKEYP--VE---NTQLQNEKLYLYYLQNGRDMYVDQEL--D--INRLSDYDVDHI | 840 |
| WP_038434062 | 778 | RERMKRIEEGIK | ELGS | DIILKEYP--VE---NTQLQNEKLYLYYLQNGRDMYVDQEL--D--INRLSDYDVDHI | 841 |
| BAQ51233 | 689 | RERMKRIEEGIK | ELGS | DIILKEYP--VE---NTQLQNEKLYLYYLQNGRDMYVDQEL--D--INRLSDYDVDHI | 752 |

```
                               -continued

KGE60162        ----------------   ----   --------------------------------    -----QEL-D--INRLSGYDVDHI    16
KGE60856        ----------------   ----   --------------------------------    -----QEL-D--INRLSGYDVDHI    16
WP_002989955  1 RERMKRIREGIK       ELGS   QILKEHP--VE---NTQLQNEKLYLYLYLQNGRDMYVDQEL-D--INRLSDYDVDHI    841
WP_003030002  778 QQRLKLLQDSLK     PVNI   K----N--VE---NQQLQNDQLFLYYIQNGKDMYTGETL-D--INNLSDYDIDHI     840
WP_003065552  781 QQRLKKLQNSLK     PSYI   E----DK-VE---NSHLQNDQLFLYYIQNGKDMYTDEL-D--IDHLSDYDIDHI      851
WP_001040076  776 RQRYKLLDDGVK     NLKS   EKKPKYV--KDqveNHHLSDDRLFLYYIQNGKDMYTDEL-D--IDNLSQYDIDHI    846
WP_001040078  779 RQRYKLLDDGVK     NLAS   NILKEYP--TD---NQALQNERLFLYYIQNGKDMYTGEAL-D--IDNLSQYDIDHI    846
WP_001040080  779 RQRYKLLDDGVK     NLAS   NILKEYP--TD---NQALQNERLFLYYIQNGKDMYTGEAL-D--IDNLSQYDIDHI    846
WP_001040081  779 RQRYKLLDDGVK     NLAS   NILKEYP--TD---NQALQNERLFLYYIQNGKDMYTGEAL-D--IDNLSQYDIDHI    846
WP_001040083  779 RQRYKLLDDGVK     NLAS   NILKEYP--TD---NQALQNERLFLYYIQNGKDMYTDDEL-D--IDDLSQYDIDHI    846
WP_001040085  779 RQRYKLLDDGVK     NLAS   NILKEYP--TD---NQALQNERLFLYYIQNGKDMYTGEAL-D--IDNLSQYDIDHI    846
WP_001040087  779 RQRYKLLDDGVK     NLAS   NILKEYP--TD---NQALQNERLFLYYIQNGKDMYTGEAL-D--IDNLSQYDIDHI    846
WP_001040088  779 RQRYKLLDDGVK     NLAS   NILKEYP--TD---NQALQNERLFLYYIQNGKDMYTGEAL-D--IDNLSQYDIDHI    846
WP_001040089  779 RQRYKLLDDGVK     NLAS   NILKEYP--TD---NQALQNERLFLYYIQNGKDMYTGEAL-D--IDNLSQYDIDHI    846
WP_001040090  779 RQRYKLLDDGVK     NLAS   NILKEYP--TD---NQALQNERLFLYYIQNGKDMYTGEAL-D--IDNLSQYDIDHI    846
WP_001040091  779 RQRYKLLDDGVK     NLAS   DILKEYP--TD---NQALQNERLFLYYIQNGKDMYTGEAL-D--IDNLSQYDIDHI    846
WP_001040092  779 RQRYKLLEDGVK     NLAS   NILKEYP--TD---NQALQNERLFLYYIQNGKDMYTGEAL-D--IDNLSQYDIDHI    846
WP_001040094  776 RQRLTTLRESLA     NLKS   EKKPKYV--KDqveNHHLSDDRLFLYYIQNGKDMYTGEAL-D--IDNLSQYDIDHI    846
WP_001040095  776 RQRLTTLRESLA     NLKS   EKKPKYV--KDqveNHHLSDDRLFLYYIQNGKDMYTDDEL-D--IDNLSQYDIDHI    846
WP_001040096  776 RQRLTTLRESLA     NLKS   EKKPKYV--KDqveNHHLSDDRLFLYYIQNGKDMYTGEAL-D--IDNLSQYDIDHI    846
WP_001040097  776 RQRLTTLRESLA     NLKS   EKKPKYV--KDqveNHHLSDDRLFLYYIQNGKDMYTGEAL-D--IDNLSQYDIDHI    846
WP_001040098  776 RQRLTTLRESLA     NLKS   EKKPKYV--KDqveNHHLSDDRLFLYYIQNGKDMYTGEAL-D--IDNLSQYDIDHI    846
WP_001040099  776 RQRLTTLRESLA     NLKS   EKKPKYV--KDqveNHHLSDDRLFLYYIQNGKDMYTGEAL-D--IDNLSQYDIDHI    846
WP_001040100  776 RQRLTTLRESLA     NLKS   EKKPKYV--KDqveNHHLSDDRLFLYYIQNGKDMYTGEAL-D--IDNLSQYDIDHI    846
WP_001040104  779 RQRYKLLDDGVK     NLAS   NILKEYP--TD---NQALQNERLFLYYIQNGKDMYTGEAL-D--IDNLSQYDIDHI    846
WP_001040105  779 RQRYKLLDDGVK     NLAS   NILKEYP--TD---NQALQNERLFLYYIQNGKDMYTGEAL-D--IDNLSQYDIDHI    846
WP_001040106  779 RQRYKLLEEGVK     NLAS   NILKEYP--TD---NQALQNERLFLYYIQNGKDMYTGEAL-D--IDNLSQYDIDHI    846
WP_001040107  779 RQRYKLLEEGVK     NLAS   NILKEYP--TD---NQALQNERLFLYYIQNGKDMYTGEAL-D--IDNLSQYDIDHI    846
WP_001040108  779 RQRYKLLEEGVK     NLAS   NILKEYP--TD---NQALQNERLFLYYIQNGKDMYTGETL-D--IDNLSQYDIDHI    846
WP_001040109  779 RQRYKLLEEGVK     NLAS   NILKEYP--TD---NQALQNERLFLYYIQNGKDMYTGEAL-D--IDNLSQYDIDHI    846
WP_001040110  779 RQRYKLLEEGVK     NLAS   DILKEYP--TD---NQALQNERLFLYYIQNGKDMYTDDEL-D--IDNLSQYDIDHI    846
WP_015058523  779 RQRYKLLDDGVK     NLAS   EKKPKYV--KDqveNHHLSDDRLFLYYIQNGKDMYTGEAL-D--IDNLSQYDIDLI    846
WP_017643650  776 RQRLTTLRESLA     NLKS   NILKEYP--TD---NQALQNERLFLYYIQNGKDMYTDDEL-D--IDNLSQYDIDHI    846
WP_017647151  779 RQRYKLLDDGVK     NLAS   NILKEYP--TD---NQALQNERLFLYYIQNGKDMYTGKAL-D--IDNLSQYDIDHI    846
WP_017648376  779 RQRYKLLDDGVK     NLAS   NILKEYP--TD---NQALQNERLFLYYIQNGKDMYTGEAL-D--IDNLSQYDIDHI    846
WP_017649527  779 RQRYKLLEEGVK     NLAS   NILKEYP--TD---NQALQNERLFLYYIQNGKDMYTGEAL-D--IDNLSQYDIDHI    860
WP_017771611  793 RQRYKLLEEGVK     NLAS   NILKEYP--TD---NQALQNERLFLYYIQNGKDMYTGEAL-D--IDNLSQYDIDHI    846
WP_017771984  776 RQRLTTLRESLA     NLKS   EKKPKYV--KDqveNHHLSDDRLFLYYIQNGKDMYTGEAL-D--IDNLSQYDIDHI    846
CFQ25032      779 RQRYKLLDDGVK     NLAS   NILKEYP--TD---NQALQNERLFLYYIQNGKDMYTDDEL-D--IDNLSQYDIDHI    846
CFV16040      779 RQRYKLLDDGVK     NLAS   NILKEYP--TD---NQALQNERLFLYYIQNGKDMYTGEAL-D--IDNLSQYDIDHI    846
KLJ37842      779 RQRYKLLDDGVK     NLAS   NILKEYP--TD---NQALQNERLFLYYIQNGKDMYTGEAL-D--IDNLSQYDIDHI    846
KLJ72361      779 RQRYKLLDDGVK     NLAS   DILKEYP--TD---NQALQNERLFLYYIQNGKDMYTDDEL-D--IDNLSQYDIDLI    846
KLL20707      793 RQRYKLLEEGVK     NLAS   NILKEYP--TD---NQALQNERLFLYYIQNGKDMYTGEAL-D--IDNLSQYDIDHI    860
KLL42645      779 RQRYKLLEEGVK     NLAS   NILKEYP--TD---NQALQNERLFLYYIQNGKDMYTGEAL-D--IDNLSQYDIDHI    846
WP_047207273  779 RQRYKLLDDGVK     NLAS   NILKEYP--TD---NQALQNERLFLYYIQNGKDMYTGEAL-D--IDNLSQYDIDHI    846
WP_047209694  776 RQRLTTLRESLA     NLKS   EKKPKYV--KDqveNHHLSDDRLFLYYIQNGKDMYTGEAL-D--IDNLSQYDIDHI    846
WP_050198062  779 RQRYKLLDDGVK     NLAS   NILKEYP--TD---NQALQNERLFLYYIQNGKDMYTDDEL-D--IDNLSQYDIDHI    846
WP_050201642  779 RQRYKLLDDGVK     NLAS   NILKEYP--TD---NQALQNERLFLYYIQNGKDMYTGEAL-D--IDNLSQYDIDHI    846
WP_050204027  779 RQRYKLLDDGVK     NLAS   NILKEYP--TD---NQALQNERLFLYYIQNGKDMYTGEAL-D--IDNLSQYDIDHI    846
WP_050881965  779 RQRYKLLEDGVK     NLAS   NILKEYP--TD---NQALQNERLFLYYIQNGKDMYTGEAL-D--IDSLSQYDIDHI    846
WP_050886065  779 RQRYKLLDDGVK     NLAS   NILKEYP--TD---NQALQNERLFLYYIQNGKDMYTGEAL-D--IDNLSQYDIDHI    846
AHN30376      779 RQRYKLLDDGVK     NLAS   NILKEYP--TD---NQALQNERLFLYYIQNGKDMYTGEAL-D--IDNLSQYDIDHI    846
EA078426      779 RQRYKLLEDGVK     NLAS   NILKEYP--TD---NQALQNERLFLYYIQNGKDMYTGEAL-D--IDNLSQYDIDHI    846
```

-continued

| | | | | | |
|---|---|---|---|---|---|
| CCW42055 | 779 | RQRYKLLDDGVR | NLAS | NILKEYP--TD---NQALQNERLFLYYLQNGRDMYTEKAL--D--IDNLSQYDIDHI | 846 |
| WP_003041502 | 778 | QQRLKLLQDSLK | PVNI | K-----N--VE---NQQLQNDRLFLYLYYIQNGRDKDMYTGETL--D--INNLSQYDIDHI | 840 |
| WP_037593752 | 779 | QQRLKLLQDSLK | PVNI | K-----N--VE---NQQLQNDRLFLYLYYIQNGKDMYTGETL--D--INNLSQYDIDHI | 841 |
| WP_049516684 | 779 | QQRLKLLQDSLK | PVNI | K-----N--VE---NQQLQNDRLFLYLYYIQNGKDMYTGETL--D--INNLSQYDIDHI | 841 |
| GAD46167 | 778 | QQRLKLLQDSLK | PVNI | K-----N--VE---NQQLQNDRLFLYLYYIQNGKDMYTGETL--D--INNLSQYDIDHI | 840 |
| WP_018363470 | 779 | QQRLKLLQNSLK | PSYI | E----DK--VE---NSHLQNDQLFLYYIQNGRDMYTGETL--D--IDHLSDYDIDHI | 849 |
| WP_003043819 | 787 | RERKKRIEEGIK | ELES | QILKEHP--VE---NTQLQNEKLYLYLYIQNGRDMYTGDEL--D--INRLSDYDVDHI | 850 |
| WP_006269658 | 778 | RERKKRIEEGIK | PVNI | K-----N--VE---NQQLQNDRLFLYLYYIQNGRDMYTGETL--D--INNLSQYDIDHI | 840 |
| WP_048800889 | 778 | QQRLKLLQDSLT | PVSI | K-----N--VE---NQQLQNDKRYLYLYIQNGRDMYTGEEL--D--IHHLSDYDIDHI | 840 |
| WP_012767106 | 777 | RERMKRIEEGIK | ELGS | QILKEHP--VE---NTQLQNEKLYLYLYIQNGRDMYTGDDL--D--INRLSDYDVDHI | 840 |
| WP_014612333 | 777 | RERMKRIEEGIK | ELGS | QILKEHP--VE---NTQLQNEKLYLYLYIQNGRDMYTGDEL--D--INRLSDYDVDHI | 840 |
| WP_015017095 | 777 | RERMKRIEEGIK | ELGS | QILKEHP--VE---NTQLQNEKLYLYLYIQNGRDMYVDQEL--D--INRLSDYDVDHI | 840 |
| WP_015057649 | 777 | RERMKRIEEGIK | ELGS | QILKEHP--VE---NTQLQNEKLYLYLYIQNGRDMYVDQEL--D--INRLSDYDVDHI | 840 |
| WP_048327215 | 777 | RERMKRIEEGIK | ELGS | QILKEHP--VE---NTQLQNEKLYLYLYIQNGRDMYVDQEL--D--IDHLSDYDVDHI | 840 |
| WP_049519324 | 777 | RERMKRIEEGIK | ELGS | QILKEHP--VE---NTQLQNEKLYLYLYIQNGRDMYVDQEL--D--IDHLSDYDVDHI | 840 |
| WP_012515931 | 777 | RQRMRKLEETAK | KLGS | QILKEHP--VD---NSQLQNDKRYLYLYIQNGRDMYVDGEL--D--IDYLSSYDIDHI | 840 |
| WP_021320964 | 777 | RQRMRKLEETAK | KLGS | QILKEHP--VD---NSQLQNDKRYLYLYIQNGRDMYTGDDL--D--IDYLSSYDIDHI | 840 |
| WP_037581760 | 777 | RQRMRKLEETAK | KLGS | NILKEHP--VD---NSQLQNDKRYLYLYIQNGRDMYTGDDL--D--IDHLSDYDIDHI | 840 |
| WP_004232481 | 777 | NQPRLKRLQDSLK | PSYV | D----SK--VE---NSHLQNDQLFLYYIQNGRDMYTGEEL--D--IDHLSDYDIDHI | 848 |
| WP_009854540 | 779 | QQRLKLQDSLK | PSYI | E----DK--VE---NSHLQNDQLFLYYIQNGKDMYTGDEL--D--IDHLSDYDIDHI | 849 |
| WP_012962174 | 781 | QQRLKKLQDSLK | PSYI | E----DK--VE---NNHLQDDRLYLYLLQDGKDMYTGKEL--D--IDRLSDYDIDHI | 851 |
| WP_039695303 | 779 | QQRLKKLQNSLK | PSYI | E----DK--VE---NSHLQNDQLFLYYIQNGKDMYTGKEL--D--IDHLSDYDIDHI | 848 |
| WP_014334983 | 777 | NQRLKKLQDSLK | PSYV | D----SK--VE---NSHLQNDQLFLYYIQNGKDMYTGKEL--D--IDRLSDYDIDHI | 848 |
| WP_003099269 | 778 | RQRLKLEEVHK | NTGS | KILKEYN--VS---NTQLQSDRLYLYLLQDGKDMYTGKEL--D--YDNLSQYDIDHI | 841 |
| AHY15608 | 778 | RQRLKLEEVHK | NTGS | KILKEYN--VS---NTQLQSDRLYLYLLQDGKDMYTGKEL--D--YDNLSQYDIDHI | 841 |
| AHY17476 | | --- | --- | --- | |
| ESR09100 | | --- | --- | --- | |
| AGM98575 | 778 | RQRLKGLKEEVHK | NTGS | KILKEYN--VS---NTQLQSDRLYLYLLQDGKDMYTGKEL--D--YDYLSQYDIDHI | 841 |
| ALF27331 | 778 | QQRLKGLTDSIK | EFGS | QILKEHP--VE---NKDLQKEKLFLYYMQNGIDLYTGQPLncD--PDSLAFYDVDHI | 841 |
| WP_018372492 | 791 | AQRLKGLKKIEDGIK | -LGS | DLLKQNP--IQd--NKDLQKEKLFLYYMQNGIDLYTGQPLncD--PDSLAFYDVDHI | 857 |
| WP_045618028 | 777 | QQRYKRIEDALK | NLAH | NILKEHP--TD---NIQLQNDRLFLYLYIQNGKDMYTGKSL--D--INQLSSYDIDHI | 844 |
| WP_045635197 | 778 | QQRYKLKIEDSLK | ILAS | NILKEHP--VE---NNQLQNDRLFLYLYIQNGKDMYTGEAL--D--INQLSSYDIDHI | 843 |
| WP_002263549 | 778 | QQRLKGLTDSIK | EFGS | QILKEHP--VE---NSQLQNDRLFLYLYIQNGKDMYTGEEL--D--IDYLSQYDIDHI | 841 |
| WP_002263887 | 778 | QQRLKGLTDSIK | EFGS | QIIKEHP--VE---NSQLQNNRLFLYLYIQNGRDMYTGEEL--D--IDYLSQYDIDHI | 841 |
| WP_002264920 | 778 | QQRLKGLTDSIK | EFGS | QIIKEHP--VE---NSQLQNDRLFLYLYIQNGRDMYTGEEL--D--IDYLSQYDIDHI | 841 |
| WP_002269043 | 778 | QQRLKGLTDSIK | EFGS | QIIKEHP--VE---NSQLQNDRLFLYLYIQNGRDMYTGEEL--D--IDYLSQYDIDHI | 841 |
| WP_002269448 | 778 | QQRLKGLTDSIK | EFGS | QIIKEHP--VE---NSQLQNDRLFLYLYIQNGRDMYTGEEL--D--IDYLSQYDIDHI | 841 |
| WP_002271977 | 778 | QQRLKGLTDSIK | EFGS | QIIKEHP--VE---NSQLQNDRLFLYLYIQNGRDMYTGEEL--D--IDYLSQYDIDHI | 841 |
| WP_002272766 | 778 | QQRLKGLTDSIK | EFGS | QIIKEHP--VE---NSQLQNDRLFLYLYIQNGRDMYTGEEL--D--IDYLSQYDIDHI | 841 |
| WP_002273241 | 778 | QQRLKGLTDSIK | EFGS | QIIKEHP--VE---NSQLQNDRLFLYLYIQNGRDMYTGEEL--D--IDYLSQYDIDHI | 841 |
| WP_002275430 | 779 | QQRYKRLKEAIK | EFGS | KILKEHP--TD---NSQLQNDRLFLYLYIQNGRDMYTGESL--D--INRLSDYDIDHV | 846 |
| WP_002276448 | 778 | QQRLKGLTDSIK | DLNH | KILKEHP--VE---NMQLQNDRLFLYLYIQNGRDMYTGESL--D--IDYLSQYDIDHI | 841 |
| WP_002277050 | 779 | QQRYKRLKEAIK | EFGS | KILKEHP--TD---NMQLQNNRLFLYLYIQNGRDMYTGESL--D--INRLSDYDIDHV | 846 |
| WP_002773364 | 778 | QQRLKGLTDSIK | EFGS | QIIKEHP--VE---HSQLQNDRLFLYLYIQNGRDMYTGEEL--D--IDYLSQYDIDHI | 841 |
| WP_002779025 | 778 | QQRLKGLTDSIK | EFGS | QIIKEHP--VE---NSQLQNDRLFLYLYIQNGRDMYTGEEL--D--IDYLSQYDIDHI | 841 |
| WP_002779859 | 778 | QQRLKGLTDSIK | EFGS | QIIKEHP--VE---NSQLQNDRLFLYLYIQNGRDMYTGEEL--D--IDYLSQYDIDHI | 841 |
| WP_002280230 | 778 | QQRLKGLTDSIK | EFGS | QIIKEHP--VE---NSQLQNDRLFLYLYIQNGRDMYTGEEL--D--IDYLSQYDIDHI | 841 |
| WP_002281696 | 778 | QQRLKGLTDSIK | EFGS | QIIKEHP--VE---NSQLQNDRLFLYLYIQNGRDMYTGEEL--D--IDYLSQYDIDHI | 841 |
| WP_002282247 | 779 | QQRYKRLKEAIK | DLNH | KILKEHP--TD---NMQLQNNRLFLYLYIQNGRDMYTGESL--D--INRLSDYDIDHV | 846 |
| WP_002282906 | 778 | QQRLKGLTDSIK | EFGS | QIIKEHP--VE---NSQLQNDRLFLYLYIQNGRDMYTGEEL--D--IDYLSQYDIDHI | 841 |
| WP_002283846 | 778 | QQRLKGLTDSIK | EFGS | QIIKEHP--VE---HSQLQNDRLFLYLYIQNGRDMYTGEEL--D--IDYLSQYDIDHI | 841 |
| WP_002287255 | 778 | QQRLKGLTDSIK | EFGS | QIIKEHP--VE---NSQLQNDRLFLYLYIQNGRDMYTGEEL--D--IDYLSQYDIDHI | 841 |
| WP_002288990 | 778 | QQRLKGLTDSIK | EFGS | QIIKEHP--VE---NSQLQNDRLFLYLYIQNGRDMYTGEEL--D--IDYLSQYDIDHI | 841 |

```
WP_002289641  778  QQRLKGLTDSIK  EFGS  QILKEHP--VE---NSQLQNDRLFLYYLQNGRDMYTGEEL--D--IDYLSQYDIDHI  841
WP_002290427  778  QQRLKGLTDSIK  EFGS  QILKEHP--VE---NSQLQNDRLFLYYLQNGRDMYTGEEL--D--IDYLSQYDIDHI  841
WP_002295753  778  QQRLKGLTDSIK  EFGS  QILKEHP--VE---NSQLQNDRLFLYYLQNGRDMYTGEEL--D--IDYLSQYDIDHI  841
WP_002296423  778  QQRLKGLTDSIK  EFGS  QILKEHP--VE---NSQLQNDRLFLYYLQNGRDMYTGEEL--D--IDYLSQYDIDHI  841
WP_002304487  788  QKRYKRLEEAIK  DLNH  KILKEHP--TD---NQALQNDRLFLYYLQNGRDMYTGEDPL-D--INRLSDYDIDHI  855
WP_002305844  778  QQRLKGLTDSIK  EFGS  QILKEHP--VE---NSQLQNDRLFLYYLQNGRDMYTGEEL--D--IDYLSQYDIDHI  841
WP_002307203  778  QQRLKGLTDSIK  EFGS  QILKEHP--VE---NSQLQNDRLFLYYLQNGRDMYTGEEL--D--IDYLSQYDIDHI  841
WP_002310390  778  QQRLKGLTDSIK  EFGS  QILKEHP--VE---NSQLQNDRLFLYYLQNGRDMYTGEEL--D--IDYLSQYDIDHI  841
WP_002352408  778  QQRLKGLTDSIK  EFGS  QILKEHP--VE---NSQLQNDRLFLYYLQNGRDMYTGEEL--D--IDYLSQYDIDHI  841
WP_012997688  778  QQRLKGLTDSIK  EFGS  QILKEHP--VK---HSQLQNDRLFLYYLQNGRDMYTGEEL--D--IDYLSQYDIDHI  841
WP_014677909  778  QQRLKGLTDSIK  EFGS  QILKEHP--VE---NSQLQNDRLFLYYLQNGRDMYTGEEL--D--IDYLSQYDIDHI  841
WP_019312892  778  QQRLKGLTDSIK  EFGS  QILKEHP--VE---NSQLQNDRLFLYYLQNGRDMYTGEEL--D--IDYLSQYDIDHI  841
WP_019313659  778  QQRLKGLTDSIK  EFGS  QILKEHP--VE---NSQLQNDRLFLYYLQNGRDMYTGEEL--D--IDYLSQYDIDHI  841
WP_019314093  778  QQRLKGLTDSIK  EFGS  QILKEHP--VE---NSQLQNDRLFLYYLQNGRDMYTGEEL--D--IDYLSQYDIDHI  841
WP_019315370  778  QQRLKGLTDSIK  EFGS  QILKEHP--VE---NSQLQNDRLFLYYLQNGRDMYTGEEL--D--IDYLSQYDIDHI  841
WP_019803776  778  QQRLKGLTDSIK  EFGS  QILKEHP--VE---NSQLQNDRLFLYYLQNGRDMYTGEEL--D--IDYLSQYDIDHI  841
WP_019805234  778  QQRLKGLTDSIK  EFGS  QILKEHP--VE---NSQLQNDRLFLYYLQNGRDMYTGEEL--D--IDYLSQYDIDHI  841
WP_024783594  778  QQRLKGLTDSIK  EFGS  QILKEHP--VE---NSQLQNDRLFLYYLQNGRDMYTGESL--D--IDYLSQYDIDHI  841
WP_024784288  779  QQRYKRLKEAIK  DLNH  KIIKEHP--TD---NQALQNNRLFLYYLQNGRDMYTGEEL--D--INRLSDYDIDHV  846
WP_024784666  778  QQRLKGLTDSIK  EFGS  QILKEHP--VE---HSQLQNDRLFLYYLQNGRDMYTGEEL--D--IDYLSQYDIDHI  841
WP_024784894  778  QQRLKGLTDSIK  EFGS  QILKEHP--VE---NSQLQNDRLFLYYLQNGRDMYTGEEL--D--IDYLSQYDIDHI  841
WP_024786433  779  QQRYKRLKEAIK  DLNH  KILKEHP--TD---NQALQNNRLFLYYLQNGRDMYTGESL--D--INRLSDYDIDHV  846
WP_049473442  776  QQRLKTLSDAIS  EFGS  QILKEHP--VE---NSQLQNDRLFLYYLQNGRDMYTGEEL--D--IDYLSQYDIDHI  841
WP_049474547  778  QQRLKGLTDSIK  EFGS  QILKEHP--VE---NSQLQNDRLFLYYLQNGRDMYTGEEL--D--IDYLSQYDIDHI  841
EMC03581      771  QQRLKGLTDSIK  ILAS  KILKEHP--TD---NIQLQNDRLFLYYLQNGRDMYTGKPL--D--INQLSSYDIDHI  834
WP_000428612  779  QQRYKRIEDSLK  NLAS  NILKEHP--TN---NIQLQNDRLFLYYLQNGRDMYTGKPL--D--INQLSSYDIDHI  846
WP_000428613  777  QQRYKRIEDALK  NLAS  NILKEHP--TD---NIQLQNDRLFLYYLQNGRDMYTGKPL--D--INQLSSYDIDHI  844
WP_029023028  776  QQRLKTLSDAIS  ELG-  KIILKEHE--IS---NAQLQSDRVYLYLLQDGKDMYTGKDL--D--FDRLSQYDIDHI  839
WP_003107102  747  RERLRKLEVHK  NIGS  KLLGS     QLLQNERLYLYYLQNGKDMYTGEEL--S--ISNLSHYDIDHI  810
WP_054279288  779  RERMKRVQEVLK  KLGS  QLLKEHP--VE---NFQLQNERLYLYYLQNGKDMYTGEEL--S--ISNLSHYDIDHI  842
WP_049531101  777  QQRYKRIEDSLK  ILAS  NILKEHP--TD---NIQLQNDRLFLYYLQNGKDMYTGNPL--D--INHLSSYDIDHI  844
WP_049538452  777  QQRYKRIENSLK  ILAS  KILKEHP--TD---NNQLQNDRLFLYYLQNGKDMYTGEAL--D--INQLSSCDIDHI  844
WP_049549711  777  QQRYKRIEDSLK  ILAS  NILKENP--TD---NNQLQNDRLFLYYLQNGKDMYTGEAL--D--INQLSSYDIDHI  844
WP_007896501  781  RQRLKKIKEVHK  KTGS  RILEDNSerIT---NLTLQDNRLYLYLLQDGKDMYTGQDL--D--INNLSQYDIDHI  846
EFR44625      733  RQRLKKIKEVHK  KTGS  RILEDNSerIT---NLTLQDNRLYLYLLQDGKDMYTGQDL--D--INNLSQYDIDHI  798
WP_002897477  776  QQRYKRIEDALK  NLAP  NILKENP--TD---NILKNDRLFLYLYLQNGKDMYTGKPL--D--INQLSSYDIDHI  843
WP_002906454  776  QQRYKRIEDALK  NLAP  NILKENP--TD---NIQLQNDRLFLYLYLQNGKDMYTGKAI--D--INQLSNYDIDHI  843
WP_009729476  777  QQRYKRIEDSLK  ILAS  KILKEHP--TD---NIQLQNDRLFLYYLQNGKDMYTGKAI--D--INQLSNYDIDHI  844
CQR24647      780  QQRLGSLTKAIQ  DFGS  DILKRYP--VE---NNQLQNDQLYLYLYLQNGKDMYTGDTL--D--INHLSNYDIDHI  843
WP_000066813  779  QQRYKRIEDSLK  NLAS  NILKEHP--TD---NIQLQNDRLFLYYLQNGKDMYTGKPL--E--INQLSNYDIDHI  846
WP_009754323  777  QQRYKRIEDALK  NLAP  TISKENP--TD---NIQLQNDRLFLYYLQNGKDMYTGEAL--D--INQLSSYDIDHI  844
WP_044674937  776  QQRYKKIENAIK  NLNS  KILKEYP--TN---NQALQNDRLFLYYLQNGKDMYTGEEL--D--INQLSSYDIDHI  843
WP_044676715  778  QQRYKKIENAIK  NLNS  KILKEYP--TN---NQALQNDRLFLYYLQNGKDMYTGDEL--D--IDQLSSYDIDHI  845
WP_044680361  778  QQRYKKIENAIK  NLNS  KILKEYP--TN---NIQLQNEKLYLYLYLQNGKDMYTGDEL--D--IDQLSQYDIDHI  845
WP_044681799  776  QQRYKKIENAIK  NLNS  KILKEYP--TN---NQALQNDRLFLYYLQNGKDMYTGDEEL-D--IDQLSQYDIDHI  843
WP_049533112  778  QQRLKLLQDSLK  PVNI  K----N--VE---NQQLQNDRLFLYYLQNGKDMYTGETL--D--INNLSQYDIDHI  840
WP_029090905  753  TPRDKFIEKAYA  ETDT  EHLKELK--Qr---SKQLSSQRLFLYFIQNGKCMYSGEHL--D--IERLDSYEVDHI  823
WP_065006696  777  ESKIKKLENVYK  DEQT  SVLEELKg-FDn--TKKILSSDSLFLYPTQLGKCMYSGKKL--D--IDSLDKYQIDHI  849
AIT42264      778  RERMKRIEEGIK  ELGS  QILKEHP--VE---NTQLQNEKLYLYLYLQNGKDMYTDEEL--D--INRLSDYDVDHI  841
WP_034440723  785  KARLKKIQEGLE  NLDS  HVEKQAL---D---EEMLKSPKYYLYCIQNGKDIYTGKDL--D--IGQLQTYDIDHI  848
AKQ21048      778  RERMKRIEEGIK  ELGS  QILKEHP--VE---NTQLQNEKLYLYLYLQNGKDMYTGVDQEL-D--INRLSDYDVDHI  841
WP_044636532  781  KERLEKLTEAIK  EFDG  --VKVKD--LK---NENLRNDRIYLYLYLQNGKDMYTNEPL--D--INNLSKYDIDHI  845
WP_002364836  789  IQRLKIVEKAMA  EIGS  NLLKEQP--TT---NEQLRDTRLFLYYMQNGKDMYTGDEL--S--LHRLSHYDIDHI  852
```

| | | | | | |
|---|---|---|---|---|---|
| WP_016631044 | 740 | IQRLKIVEKAMA | EIGS | NLLKEQP--TT---NEQLRDTRLFLYYMQNGKDMYTGDEL--S--LHRLSHYDIDHI | 803 |
| EM575795 | 525 | KPRLKALEEALK | SFDS | PLLKEQP--VD---NQALQKDRLYLYYIQNGKDRMYTGEAL--D--IDRLSEYDIDHI | 588 |
| WP_002373311 | 789 | IQRLKIVEKAMA | EIGS | NLLKEQP--TT---NEQLRDTRLFLFLYYMQNGKDMYTGDEL--S--LHRLSHYDIDHI | 852 |
| WP_002378009 | 789 | IQRLKIVEKAMA | EIGS | NLLKEQP--TT---NEQLRDTRLFLFLYYMQNGKDMYTGDEL--S--LHRLSHYDIDHI | 852 |
| WP_002407324 | 789 | IQRLKIVEKAMA | EIGS | NLLKEQP--TT---NEQLRDTRLFLFLYYMQNGKDMYTGDEL--S--LHRLSHYDIDHI | 852 |
| WP_002413717 | 789 | IQRLKIVEKAMA | EIGS | NLLKEQP--TT---NEQLRDTRLFLFLYYMQNGKDMYTGDEL--S--LHRLSHYDIDHI | 852 |
| WP_010775580 | 791 | IQRLKIVEKAMA | EIGS | NLLKEQP--TT---NEQLRDTRLFLFLYYMQNGKDMYTGDEL--S--LHRLSHYDIDHI | 854 |
| WP_010818269 | 789 | IQRLKIVEKAMA | EIGS | NLLKEQP--TT---NEQLRDTRLFLFLYYMQNGKDMYTGDEL--S--LHRLSHYDIDHI | 852 |
| WP_010824395 | 789 | IQRLKIVEKAMA | EIGS | NLLKEQP--TT---NEQLRDTRLFLFLYYMQNGKDMYTGDEL--S--LHRLSHYDIDHI | 852 |
| WP_016622645 | 789 | IQRLKIVEKAMA | EIGS | NLLKEQP--TT---NEQLRDTRLFLFLYYMQNGKDMYTGDEL--S--LHRLSHYDIDHI | 852 |
| WP_033624816 | 789 | IQRLKIVEKAMA | EIGS | NLLKEQP--TT---NEQLRDTRLFLFLYYMQNGKDMYTGDEL--S--LHRLSHYDIDHI | 852 |
| WP_033625576 | 789 | IQRLKIVEKAMA | EIGS | NLLKEQP--TT---NEQLRDTRLFLFLYYMQNGKDMYTGDEL--S--LHRLSHYDIDHI | 852 |
| WP_033789179 | 789 | IQRLKIVEKAMA | EIGS | NLLKEQP--TT---NEQLRDTRLFLFLYYMQNGKDMYTGDEL--S--LHRLSHYDIDHI | 852 |
| WP_002310644 | 789 | RPRLKALEESLK | DFGS | QLLKEYP--TD---NSSLQKDRLYLYLYYIQNGRDMYTGAPL--D--IHRLSDYDIDHI | 852 |
| WP_002312694 | 790 | RPRLKALEESLK | DFGS | QLLKEYP--TD---NSSLQKDRLYLYLYYIQNGRDMYTGAPL--D--IHRLSDYDIDHI | 853 |
| WP_002314015 | 790 | RPRLKALEESLK | DFGS | QLLKEYP--TD---NSSLQKDRLYLYLYYIQNGRDMYTGAPL--D--IHRLSDYDIDHI | 853 |
| WP_002320716 | 790 | RPRLKALEESLK | DFGS | QLLKEYP--TD---NSSLQKDRLYLYLYYIQNGRDMYTGAPL--D--IHRLSDYDIDHI | 853 |
| WP_002330729 | 789 | RPRLKALEESLK | DFGS | QLLKEYP--TD---NSSLQKDRLYLYLYYIQNGRDMYTGAPL--D--IHRLSDYDIDHI | 852 |
| WP_002335161 | 790 | RPRLKALEESLK | DFGS | QLLKEYP--TD---NSSLQKDRLYLYLYYIQNGRDMYTGAPL--D--IHRLSDYDIDHI | 853 |
| WP_002345439 | 790 | RPRLKALEESLK | DFGS | QLLKEYP--TD---NSSLQKDRLYLYLYYIQNGRDMYTGAPL--D--IHRLSDYDIDHI | 853 |
| WP_034867970 | 781 | SPRLKALENGLK | QIGS | TLLKEQP--TD---NKALQKERLYLYLYYIQNGRDMYTGEPL--E--IENLHQYEVDHI | 844 |
| WP_047937432 | 790 | RPRLKALEESLK | DFGS | QLLKEYP--TD---NSSLQKDRLYLYLYYIQNGRDMYTGAPL--D--IHRLSDYDIDHI | 853 |
| WP_010720994 | 781 | KPRLKALENGLK | QIGS | TLLKEQP--TD---NKALQKERLYLYLYYIQNGRDMYTGEPL--E--IENLHQYEVDHI | 844 |
| WP_010737004 | 781 | SPRLKALENGLK | QIGS | TLLKEQP--TD---NKALQKERLYLYLYYIQNGRDMYTGEPL--E--IENLHQYEVDHI | 844 |
| WP_034700478 | 781 | KPRLKALENGLK | QIGS | TLLKEQP--TD---NKALQKERLYLYLYYIQNGRDMYTGEPL--E--IENLHQYEVDHI | 844 |
| WP_007209003 | 782 | KPRLKGIENGLK | EFSD | SVLKGSS--ID---NKQLQNDRLYLYLYYIQNGRDMYTGHEL--D--IDHLSTYDIDHI | 845 |
| WP_023519017 | 775 | RPRLKEEALK | NIDS | PLIKDYP--TD---NQALQNDRLYLYLYYIQNGRDMYTGEPL--E--LHRLSEYDIDHI | 838 |
| WP_010770040 | 782 | NPRMKALEEAMR | NLRS | NLLKEYP--TD---NQALQNDRLYLYLYYIQNGRDMYTGLDL--S--LHRLSSYDIDHI | 845 |
| WP_048604708 | 779 | RPRLKNLEKAID | DLDS | EILKKHP--VD---NKALQKDRLYLYLYYIQNGRDMYTNEEL--D--IHKLSTYDIDHI | 842 |
| WP_010750235 | 784 | KPRLKSLEEALK | NFDS | QLLKERP--VD---NQSLQNEKLYLYLYYIQNGRDMYTGESL--D--INRLSEYDIDHI | 847 |
| AII16583 | 817 | RERMKRIEEGIK | ELGS | QILKEHP--VE---NTQLQNEKLYLYTQMGKCMYTGKSL--D--IDRLDTYQVDHI | 880 |
| WP_029073316 | 789 | DSFVNQMLKLYK | DFED | EANKHLKg-EDa--KSKIRSERLKLYYTQMGKCMYTGKSL--D--IDRLDTYQVDHI | 860 |
| WP_031589969 | 789 | DSFVNQMLKLYK | DFED | EANKHLKg-EDa--KSKIRSERLKLYYTQMGKCMYTGKSL--D--IDRLDTYQVDHI | 860 |
| KDA45870 | 772 | EDRVQQIVKNLK | ELPK | -----P---S---NAELSDERKYLYCLQNGRDMYTGAPL--D--YDHLQFYDVDHI | 833 |
| WP_039099354 | 789 | KRQVEQVYQNIS | EL-- | EIRNELK---DI-sNSALSNTRLFLYFMQGGRDMYTGDSL--N--IDRLSTYDIDHI | 856 |
| AKP02966 | 786 | RLQSKLLNKANG | -LVP | EELKKKHn--D---LsSSERIMLYFLQNGKSLYSEESL--N--INKLSDYQVDHI | 858 |
| WP_010991369 | 781 | RPRYKSLEKAIK | EFGS | QIILKEHP--TD---NQELRNNRLYLYLYYIQNGKDIYTGQDL--D--IHNLSNYDIDHI | 844 |
| WP_033838504 | 781 | RPRYKSLEKAIK | DFGS | QIILKEHP--TD---NQELRNNRLYLYLYYIQNGKDIYTGQDL--D--IHNLSNYDIDHI | 844 |
| EHN60060 | 784 | RPRYKSLEKAIK | EFGS | QIILKEHP--TD---NQELRNNRLYLYLYYIQNGKDIYTGQEL--D--IHNLSNYDIDHI | 847 |
| EFR89594 | 550 | RPRYKSLEKAIK | EFGS | QIILKEHP--TD---NQELRNNRLYLYLYYIQNGKDMYTGQDL--D--IHNLSNYDIDHI | 613 |
| WP_038409211 | 781 | RPRFISLEKAIK | EFGS | QIILKEHP--TD---NQCLKNDRLYLYLYYIQNGKDMYTGKEL--D--IHNLSNYDIDHI | 844 |
| EFR95520 | 400 | RPRFISLEKAIK | EFGS | QIILKEHP--TD---NQCLKNDRLYLYLYYIQNGKDMYTGKEL--D--IHNLSNYDIDHI | 463 |
| WP_003723650 | 781 | KPRYKSLEKAIK | EFGS | QIILKEHP--TD---NQELKNNRLYLYLYYIQNGKDIYTGQEL--D--IHNLSNYDIDHI | 844 |
| WP_003727705 | 781 | KPRYKSLEKAIK | EFGS | QIILKEHP--TD---NQELKNNRLYLYLYYIQNGKDIYTGQEL--D--IHNLSNYDIDHI | 844 |
| WP_003730785 | 781 | KPRYKSLEKAIK | DFGS | QIILKEHP--TD---NQELKNNRLYLYLYYIQNGKDIYTGQEL--D--IHNLSNYDIDHI | 844 |
| WP_003733029 | 781 | RPRYKSLEKAIK | EFGS | QIILKEHP--TD---NQELKNNRLYLYLYYIQNGKDMYTGQEL--D--IHNLSNYDIDHI | 844 |
| WP_003739838 | 781 | RPRYKSLEKAIK | EFGS | QIILKEHP--TD---NQELKNNRLYLYLYYIQNGKDMYTGQDL--D--IHNLSNYDIDHI | 844 |
| WP_014601172 | 781 | KPRYKSLEKAIK | EFGS | KIILKEHP--TD---NQCLKNDRLYLYLYYIQNGKDMYTGKEL--D--IHNLSNYDIDHI | 844 |
| WP_023548323 | 781 | KPRYKSLEKAIK | EFGS | QIILKEHP--TD---NQELKNNRLYLYLYYIQNGKDMYTGQEL--D--IHNLSNYDIDHI | 844 |
| WP_031665337 | 781 | KPRYKSLEKAIK | EFGS | QIILKEHP--TD---NQELKNNRLYLYLYYIQNGKDMYTGQEL--D--IHNLSNYDIDHI | 844 |
| WP_031669209 | 781 | KPRYKSLEKAIK | EFGS | QIILKEHP--TD---NQELKNNRLYLYLYYIQNGKDMYTGQEL--D--IHNLSNYDIDHI | 844 |
| WP_033920898 | 781 | KPRYKSLEKAIK | EFGS | QIILKEHP--TD---NQELKNNRLYLYLYYIQNGKDMYTGQEL--D--IHNLSNYDIDHI | 844 |
| AKI42028 | 784 | KPRYKSLEKAIK | EFGS | KIILKEHP--TD---NQELKNNRLYLYLYYIQNGKDMYTGQEL--D--IHNLSNYDIDHI | 847 |

-continued

```
AKI50529         784 KPRYKSLEKAIK   EFGS QILKEHP--TD---NQELKNNRLYLYYLQNGKDMYTQEL--D--IHNLSNYDIDHI    847
EFR83390         229 RPRYKSLEKAIK   EFGS QILKEHP--TD---NQELKNNRLYLYYLQNGKDIYTQEL--D--IHNLSNYDIDHI    292
WP_046323366     781 KPRFTSLEKAIK   ELGS QILKEHP--TD---NQGLKNDRLYLYYLQNGKDMYTQEL--D--IHNLSNYDIDHV    844
AKE81011         794 RERMKRIEEGIK   ELGS QILKEHP--VE---NTQLQNEKLYLYYLQNGRDMYVDQEL--D--INRLSDYDVDHI    857
CU082355         781 ESKIKKLENVYK   DEQT SVLEELKg-FDn--TKKISSDSLFLYPTQLGKCMYSGKKL--D--IDSLDKYQIDHI    853
WP_033162887     784 ESKIAKLQKIYE   NLQT QVYESLKk-EDa--KKRMETDAIYLYYLQMGKSMYSGKPL--D--IDKLSTYQIDHI    855
AGZ01981         811 RERMKRIEEGIK   ELGS QILKEHP--VE---NTQLQNEKLYLYYLQNGRDYDVDHI--D--INRLSDYDVDHI    874
AKA60242         778 RERMKRIEEGIK   ELGS QILKEHP--VE---NTQLQNEKLYLYYLQNGRDMYVDQEL--D--INRLSDYDVDHI    841
AKS40380         778 RERMKRIEEGIK   ELGS QILKEHP--VE---NTQLQNEKLYLYYLQNGRDMYVDQEL--D--INRLSDYDVDAI    841
4UN5_B           782 RERMKRIEEGIK   ELGS QILKEHP--VE---NTQLQNEKLYLYYLQNGRDMYVDQEL--D--INRLSDYDVDAI    845

WP_010922251     842 VPQSFLKDDSIDNKVLTRSDKNRG-KSDN--VP  S--EEVVKKMKN-YWRQLLNAKLITQRKFDNLTKA--ERG GLSE      910

WP_039695303     852 IPQAFIKDDSIDNRVLTSSAKNRG-KSDD--VP  S--LDIVRARKA-EWVRLYKSGLISKRKFDNLTKA--ERGGLTE      920
WP_045635197     844 IPQAFIKDDSLDNRVLTSSKDNRG-KSDN--VP  S--IEVVQKRKA-FWQQLLDSKLISERKFNNLTKA--ERGGLDE      912
5AXW_A           562 IPRSVSPDNSFNNKVLVKQEEASK-KGNR--TP  FQy-LSSSDDSKI-SYETFKKHILNLAKGKGRISKTk-KEYLLEE    632
WP_009880683     526 VPQSFIKDDSIDNKVLTRSDKNRG-KSDN--VP  S--EEVVKKMKN-YWRQLLNAKLITQRKFDNLTKA--ERGGLSE      594
WP_010922251     842 VPQSFIKDDSIDNKVLTRSDKNRG-KSDN--VP  S--EEVVKKMKN-YWRQLLNAKLITQRKFDNLTKA--ERGGLSE      910
WP_011054416     842 VPQSFIKDDSIDNKVLTRSDKNRG-KSNN--VP  S--EEVVKKMKN-YWRQLLNAKLITQRKFDNLTKA--ERGGLSE      910
WP_011284745     842 VPQSFIKDDSIDNKVLTRSDKNRG-KSDN--VP  S--EEVVKKMKN-YWRQLLNAKLITQRKFDNLTKA--ERGGLSE      910
WP_011285506     842 VPQSFIKDDSIDNKVLTRSDKNRG-KSDN--VP  S--EEVVKKMKN-YWRQLLNAKLITQRKFDNLTKA--ERGGLSE      910
WP_011527619     842 VPQSFIKDDSIDNKVLTRSDKNRG-KSDN--VP  S--EEVVKKMKN-YWRQLLNAKLITQRKFDNLTKA--ERGGLSE      910
WP_012560673     842 VPQSFIKDDSIDNKVLTRSDKNRG-KSDN--VP  S--EEVVKKMKN-YWRQLLNAKLITQRKFDNLTKA--ERGGLSE      910
WP_014407541     841 VPQSFIKDDSIDNKVLTRSDKNRG-KSDN--VP  S--EEVVKKMKN-YWRQLLNAKLITQRKFDNLTKA--ERGGLSE      909
WP_020905136     842 VPQSFIKDDSIDNKVLTRSDKNRG-KSDN--VP  S--EEVVKKMKN-YWRQLLNAKLITQRKFDNLTKA--ERGGLSE      910
WP_023080005     841 VPQSFIKDDSIDNKVLTRSDKNRG-KSDN--VP  S--EEVVKKMKN-YWRQLLNAKLITQRKFDNLTKA--ERGGLSE      909
WP_023610282     841 VPQSFIKDDSIDNKVLTRSDKNRG-KSDN--VP  S--EEVVKKMKN-YWRQLLNAKLITQRKFDNLTKA--ERGGLSE      909
WP_030125963     842 VPQSFIKDDSIDNKVLTRSDKNRG-KSDN--VP  S--EEVVKKMKN-YWRQLLNAKLITQRKFDNLTKA--ERGGLSE      910
WP_030126706     842 VPQSFIKDDSIDNKVLTRSDKNRG-KSDN--VP  S--EEVVKKMKN-YWRQLLNAKLITQRKFDNLTKA--ERGGLSE      910
WP_031488318     842 VPQSFIKDDSIDNKVLTRSDKNRG-KSDN--VP  S--EEVVKKMKN-YWRQLLNAKLITQRKFDNLTKA--ERGGLSE      910
WP_032460140     842 VPQSFIKDDSIDNKVLTRSDKNRG-KSDN--VP  S--EEVVKKMKN-YWRQLLNAKLITQRKFDNLTKA--ERGGLSE      910
WP_032461047     842 VPQSFIKDDSIDNKVLTRSDKNRG-KSDN--VP  S--EEVVKKMKN-YWRQLLNAKLITQRKFDNLTKA--ERGGLSE      910
WP_032462016     842 VPQSFIKDDSIDNKVLTRSDKNRG-KSDN--VP  S--EEVVKKMKN-YWRQLLNAKLITQRKFDNLTKA--ERGGLSE      910
WP_032462936     842 VPQSFIKDDSIDNKVLTRSDKNRG-KSDN--VP  S--EEVVKKMKN-YWRQLLNAKLITQRKFDNLTKA--ERGGLSE      910
WP_032464890     842 VPQSFIKDDSIDNKVLTRSDKNRG-KSDN--VP  S--EEVVKKMKN-YWRQLLNAKLITQRKFDNLTKA--ERGGLSE      910
WP_033888930     667 VPQSFIKDDSIDNKVLTRSDKNRG-KSDN--VP  S--EEVVKKMKN-YWRQLLNAKLITQRKFDNLTKA--ERGGLSE      735
WP_038431314     842 VPQSFIKDDSIDNKVLTRSDKNRG-KSDN--VP  S--EEVVKKMKN-YWRQLLNAKLITQRKFDNLTKA--ERGGLSE      910
WP_038432938     841 VPQSFIKDDSIDNKVLTRSDKNRG-KSDN--VP  S--EEVVKKMKN-YWRQLLNAKLITQRKFDNLTKA--ERGGLSE      909
WP_038434062     842 VPQSFIKDDSIDNKVLTRSDKNRG-KSDN--VP  S--EEVVKKMKN-YWRQLLNAKLITQRKFDNLTKA--ERGGLSE      910
BAQ51233         753 VPQSFIKDDSIDNKVLTRSDKNRG-KSDN--VP  S--EEVVKKMKN-YWRQLLNAKLITQRKFDNLTKA--ERGGLSE      821
KGE60162          17 VPQSFIKDDSIDNKVLTRSDKNRG-KSDN--VP  S--EEVVKKMKN-YWRQLLNAKLITQRKFDNLTKA--ERGGLSE       85
KGE60856              ----------------------------------  -------------------------------------------      
WP_002989955     842 VPQSFIKDDSIDNKVLVSSAKNRG-KSDD--VP  S--BEVVKKMKN-YWRQLLNAKLITQRKFDNLTKA--ERGGLSE      910
WP_003030002     841 IPQAFIKDNSLDNRVLTRSDKNRG-KSDD--VP  S--IEVVHEMKS-FWSKLLSVKLITQRKFDNLTKA--ERGGLDE      909
WP_003065552     852 IPQAFIKDDSIDNRVLSSAKNRG-KSDD--VP   S--LDIVRARKA-EWVRLYKSGLISKRKFDNLTKA--ERGGLTE      920
WP_001040076     847 IPQAFIKDDSIDNRVLVSSAKNRG-KSDD--VP  S--LEIVKDCKV-FWKKLLDAKLMSQRKYDNLTKA--ERGGLTS      915
WP_001040078     847 IPQAFIKDDSIDNRVLVSSAKNRG-KSDD--VP  S--LEIVKDCKV-FWKKLLDAKLMSQRKYDNLTKA--ERGGLTS      915
WP_001040080     847 IPQAFIKDDSIDNRVLVSSAKNRG-KSDD--VP  S--LEIVKDCKV-FWKKLLDAKLMSQRKYDNLTKA--ERGGLTS      915
WP_001040081     847 IPQAFIKDDSIDNRVLVSSAKNRG-KSDD--VP  S--LEIVKDCKV-FWKKLLDAKLMSQRKYDNLTKA--ERGGLTS      915
WP_001040083     847 IPQAFIKDDSIDNRVLVSSAKNRG-KSDD--VP  S--LEIVKDCKV-FWKKLLDAKLMSQRKYDNLTKA--ERGGLTS      915
WP_001040085     847 IPQAFIKDDSIDNRVLVSSAKNRG-KSDD--VP  S--LEIVKDCKV-FWKKLLDAKLMSQRKYDNLTKA--ERGGLTS      915
WP_001040087     847 IPQAFIKDDSIDNRVLVSSAKNRG-KSDD--VP  S--LEIVKDCKV-FWKKLLDAKLMSQRKYDNLTKA--ERGGLTS      915
```

| | | | | |
|---|---|---|---|---|
| WP_001040088 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040089 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040090 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040091 | 847 | IPQAFIKDDSIDNRVLVSSAKNRG-KSDD--VP | S--LEIVKDCKV-FWKKLLDAKLMSQRKYDNLTKA--ERGGLTP | 915 |
| WP_001040092 | 847 | IPQAFIKDDSIDNRVLVSSAKNRG-KSDD--VP | S--IDIVKARKA-FWKKLLDAKLMSQRKYDNLTKA--ERGGLTS | 915 |
| WP_001040094 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040095 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040096 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040097 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040098 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040099 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040100 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_001040104 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_001040105 | 847 | VPQAFIKDDSIDNRVLVSSAKNRG-KSDD--VP | S--IDIVKARKA-FWKKLLDAKLMSQRKYDNLTKA--ERGGLTS | 915 |
| WP_001040106 | 847 | VPQAFIKDDSIDNRVLVSSAKNRG-KSDN--VP | S--IDIVKARKA-FWKKLLDAKLMSQRKYDNLTKA--ERGGLTS | 915 |
| WP_001040107 | 847 | VPQAFIKDDSIDNRVLVSSAKNRG-KSDN--VP | S--IDIVKARKA-FWKKLLDAKLMSQRKYDNLTKA--ERGGLTS | 915 |
| WP_001040108 | 847 | VPQAFIKDDSIDNRVLVSSAKNRG-KSDN--VP | S--IDIVKARKA-FWKKLLDAKLMSQRKYDNLTKA--ERGGLTS | 915 |
| WP_001040109 | 847 | IPQAFIKDDSIDNRVLVSSAKNRG-KSDN--VP | S--IDIVKARKA-FWKKLLDAKLMSQRKYDNLTKA--ERGGLTS | 915 |
| WP_001040110 | 847 | VPQAFIKDDSIDNRVLVSSAKNRG-KSDN--VP | S--IDIVKARKA-FWKKLLDAKLISQRKYDNLTKA--ERGGLTP | 915 |
| WP_015058523 | 847 | VPQAFIKDDSIDNRVLVSSAKNRG-KSDN--VP | S--IDIVKARKA-FWKKLLDAKLISQRKYDNLTKA--ERGGLTS | 915 |
| WP_017643650 | 847 | VPQAFIKDDSIDNRVLVSSAKNRG-KSDN--VP | S--VEIVKDCKV-FWKKLLDAKLMSQRKYDNLTKA--ERGGLTS | 915 |
| WP_017647151 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017648376 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017649527 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017771611 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_017771984 | 847 | IPQAFIKDDSIDNRVLVSSAKNRG-KSDN--VP | S--IDIVKARKA-FWKKLLDAKLMSQRKYDNLTKA--ERGGLTS | 915 |
| CFQ25032 | 847 | IPQAFIKDDSIDNRVLVSSAKNRG-KSDD--VP | S--LEIVKDCKV-FWKKLLDAKLMSQRKYDNLTKA--ERGGLTS | 915 |
| CFV16040 | 847 | IPQAFIKDDSIDNRVLVSSAKNRG-KSDD--VP | S--LEIVKDCKV-FWKKLLDAKLMSQRKYDNLTKA--ERGGLTS | 915 |
| KLJ37842 | 861 | IPQAFIKDDSIDNRVLVSSAKNRG-KSDD--VP | S--LEIVKDCKV-FWKKLLDAKLMSQRKYDNLTKA--ERGGLTS | 929 |
| KLJ72361 | 847 | IPQAFIKDDSIDNRVLVSSAKNRG-KSDD--VP | S--IDIVKARKA-FWKKLLDAKLMSQRKYDNLTKA--ERGGLTS | 915 |
| KLL20707 | 847 | IPQAFIKDDSIDNRVLVSSAKNRG-KSDD--VP | S--LEIVKDCKV-FWKKLLDAKLMSQRKYDNLTKA--ERGGLTS | 915 |
| KLL42645 | 847 | IPQAFIKDDSIDNRVLVSSAKNRG-KSDD--VP | S--VEIVKDCKV-FWKKLLDAKLMSQRKYDNLTKA--ERGGLTS | 915 |
| WP_047207273 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_047209694 | 847 | IPQAFIKDDSIDNRVLVSSAKNRG-KSDD--VP | S--LEIVKDCKV-FWKKLLDAKLMSQRKYDNLTKA--ERGGLTS | 915 |
| WP_050198062 | 847 | IPQAFIKDDSIDNRVLVSSAKNRG-KSDN--VP | S--LEIVKDCKV-FWKKLLDAKLMSQRKYDNLTKA--ERGGLTS | 915 |
| WP_050201642 | 847 | IPQAFIKDDSIDNRVLVSSAKNRG-KSDN--VP | S--IDIVKARKA-FWKKLLDAKLMSQRKYDNLTKA--ERGGLTS | 915 |
| WP_050204027 | 847 | IPQAFIKDDSIDNRVLVSSAKNRG-KSDN--VP | S--IDIVKARKA-FWKKLLDAKLMSQRKYDNLTKA--ERGGLTS | 915 |
| WP_050881965 | 847 | IPQAFIKDDSIDNRVLVSSAKNRG-KSDN--VP | S--LEIVKDCKV-FWKKLLDAKLMSQRKYDNLTKA--ERGGLTS | 915 |
| WP_050886065 | 847 | IPQAFIKDDSIDNRVLVSSAKNRG-KSDD--VP | S--LEIVKDCKV-FWKKLLDAKLMSQRKYDNLTKA--ERGGLTS | 915 |
| AHN30376 | 847 | IPQAFIKDDSIDNRVLVSSAKNRG-KSDD--VP | S--IDIVKARKA-FWKKLLDAKLISQRKYDNLTKA--ERGGLTP | 915 |
| EA078426 | 847 | IPQAFIKDDSIDNRVLVSSENRG-KSDN--VP | S--LEIVKDCKV-FWKKLLDAKLMSQRKYDNLTKA--ERGGLTS | 915 |
| CCW42055 | 847 | IPQAYIKDDSIDNRVLTSSENRG-KSDN--VP | S--IEVVCARKA-DWMRLRKAGLISQRKFDNLTKA--ERGGLTE | 909 |
| WP_003041502 | 841 | IPQAFIKDNSLDNRVLTRSDKNRG-KSDN--VP | S--IEVVHEMKS-FWSKLLSVKLITQRKFDNLTKA--ERGGLTE | 910 |
| WP_037593752 | 842 | IPQAFIKDNSLDNRVLTRSDKNRG-KSDN--VP | S--IEVVHEMKS-FWSKLLSVKLITQRKFDNLTKA--ERGGLTE | 910 |
| WP_049516684 | 842 | IPQAFIKDNSLDNRVLTRSDKNRG-KSDN--VP | S--IEVVHEMKS-FWSKLLSVKLITQRKFDNLTKA--ERGGLTE | 909 |
| GAD46167 | 841 | IPQAFIKDNSLDNRVLTRSDKNRG-KSDN--VP | S--IEVVHEMKS-FWSKLLSVKLITQRKFDNLTKA--ERGGLTE | 909 |
| WP_018363470 | 850 | IPQAFIKDDSIDNRVLTRSVENRG-KSDN--VP | S--LGIVRARKA-EWVRLYKSGLISKRKFDNLTKA--ERGGLTE | 918 |
| WP_003043819 | 851 | VPQSFIKDDSIDNRVLTRSDKNRG-KSDN--VP | S--BEVVKKMKN-YWRQLLNAKLITQRKFDNLTKA--ERGGLSE | 919 |
| WP_006269658 | 841 | IPQSFIKDSLDNRVLTRSDKNRG-KSDN--VP | S--BEVVKKMKN-FWSKLLSVKLITQRKFDNLTKA--ERGGLSE | 909 |
| WP_048800889 | 841 | IPQAFIKDSLDNRVLTRSDKNRG-KSDN--VP | N--LEVVCDRKA-DWIRLREAGLISQRKFDNLTKA--ERGGLTE | 909 |
| WP_012677106 | 841 | VPQSFIKDDSIDNKILTRSDKNRG-KSDN--VP | S--BEVVKKMKN-YWRQLLNAKLITQRKFDNLTKA--ERGGLSE | 909 |
| WP_014612333 | 841 | VPQSFIKDDSIDNKVLTRSDKNRG-KSDN--VP | S--BEVVHEMKS-YWRQLLNAKLITQRKFDNLTKA--ERGGLSE | 909 |
| WP_015017095 | 841 | VPQSFIKDDSIDNKVLTRSDKNRG-KSDN--VP | S--BEVVKKMKN-YWRQLLNAKLITQRKFDNLTKA--ERGGLSE | 909 |

| ID | Seq1 | pos1 | Seq2 | pos2 |
|---|---|---|---|---|
| WP_015057649 | VPQSFIKDDSIDNKVLTRSDKNRG-KSDN--VP | 841 | S--EEVVKKMKN-YWRQLLNAKLITQRKFPDNLTKA--ERGGLSE | 909 |
| WP_048327215 | VPQSFIKDDSIDNKVLTRSDKNRG-KSDN--VP | 841 | S--EEVVKKMKN-YWRQLLNAKLITQRKFPDNLTKA--ERGGLSE | 909 |
| WP_049519324 | VPQSFIKDDSIDNKVLTSDKNRG-KSDN--VP | 841 | S--EEVVKKMKN-YWRQLLNAKLITQRKFPDNLTKA--ERGGLSE | 909 |
| WP_012515931 | IPQSFIKNNSIDNKVLTSQGANRG-KLDN--VP | 841 | S--EAIVRKMKG-YWQSLLRAGAISKQKFPDNLTKA--ERGGLTQ | 909 |
| WP_021320964 | IPQSFIKNNSIDNKVLTSQGANRG-KLDN--VP | 841 | S--EAIVRKMKG-YWQSLLRAGAISKQKFPDNLTKA--ERGGLTQ | 909 |
| WP_037581760 | IPQAFIKDNSIDNRVLTSSAKNRG-KSDD--VP | 849 | S--IEIVRNRKS-YWYKLYKSGLLISKRKFPDNLTKA--ERGGLTE | 917 |
| WP_004232481 | IPQAFIKDNSIDNRVLTSSAKNRG-KSDD--VP | 849 | S--IEIVRNRKS-YWYKLYKSGLLISKRKFPDNLTKA--ERGGLTE | 917 |
| WP_009854540 | IPQAFIKDDSIDNRVLTSSAKNRG-KSDD--VP | 850 | S--LDIVRARKA-EWRLYKSGLLISKRKFPDNLTKA--ERGGLTE | 918 |
| WP_012962174 | IPQAFIKDDSIDNRVLTSSAKNRG-KSDD--VP | 850 | S--LDIVHDRKA-DWIRLYKSGLLISKRKFPDNLTKA--ERGGLTE | 918 |
| WP_039695303 | IPQAFIKDNSIDNKVLTSSAKNRG-KSDD--VP | 852 | S--LDIVRARKA-EWRLYKSGLLISKRKFPDNLTKA--ERGGLTE | 920 |
| WP_014334983 | IPQAFIKDDSIDNKVLTSSAKNRG-KSDD--VP | 849 | S--IEIVRNRRS-YWYKLYKSGLLISKRKFPDNLTKA--ERGGLTE | 917 |
| WP_003099269 | IPQSFIKDNSIDNTVLTQASNRG-KSDN--VP | 842 | N--IETVNKMKS-FWYKQLKSGALSQRKFDHLTKA--ERGALSD | 910 |
| AHY15608 | IPQSFIKDNSIDNTVLTQASNRG-KSDN--VP | 842 | N--IETVNKMKS-FWYKQLKSGALSQRKFDHLTKA--ERGALSD | 910 |
| AHY17476 | IPQSFIKDNSIDNTVLTQASNRG-KSDN--VP | 842 | N--IETVNKMKS-FWYKQLKSGALSQRKFDHLTKA--ERGALSD | 910 |
| ESR09100 | --------------------------- | | ---------------------------------- | |
| AGM98575 | IPQSFIKDNSIDNTVLTQASNRG-KSDN--VP | 842 | N--IETVNKMKS-FWYKQLKSGALSQRKFDHLTKA--ERGALSD | 910 |
| ALF27331 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_018372492 | VPRSYIKNDSFDNKVLTSKGNRK-KLDD--VP | 858 | A--KEVVEKMEN-TWRRLHAAGLISDIKLSYLMKGe----LTE | 923 |
| WP_045618028 | IPQAFIKDDSLDNRVLTSSKDNRG-KSDN--VP | 845 | S--LEIVQKRKA-FWQQLLDSKLISERKFPNNLTKA--ERGGLDE | 913 |
| WP_045635197 | IPQAFIKDNSIDNRVLTSSKENRG-KSDN--VP | 844 | S--IEVVQKRKA-FWQQLLDSKLISERKFNNLTKA--ERGGLDE | 912 |
| WP_002263549 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002263887 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002264920 | IPQAFIKDNSIDNRVLTSSKENRG-KSDD--VP | 842 | S--KDVVRKMKS-YWSKLLSAKLITQRKFPDNLTKG--ERGGLTD | 910 |
| WP_002269043 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002269448 | IPQAFIKDNSIDNRVLTSSKENRG-KSDD--VP | 842 | S--EDVVRKMKS-YWSKLLSAKLITQRKFPDNLTKA--ERGGLTD | 910 |
| WP_002271977 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002272766 | IPQAFIKDNSIDNRVLTSSKENRG-KSDD--VP | 842 | S--KDVVRKMKP-YWSKLLSAKLITQRKFPDNLTKA--ERGGLTD | 910 |
| WP_002273241 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002275430 | IPQAFIKDNSIDNRVLTSSKENRG-KSDD--VP | 842 | S--KDVVRKMKP-YWSKLLSAKLITQRKFPDNLTKA--ERGGLTD | 910 |
| WP_002276448 | IPQAFIKDNSIDNRVLTSSKANRG-KSDD--VP | 847 | S--KDVVRKMKS-YWSKLLSSGLISQRKYNNLTKK--E--LTP | 912 |
| WP_002277050 | IPQAFIKDNSIDNRVLTSSKENRG-KSDD--VP | 842 | S--EDVVNRMRP-FWNKLLSSGLISQRKYNNLTKK--E---LTL | 910 |
| WP_002277364 | IPQAFIKDNSIDNRVLTSSKENRG-KSDD--VP | 842 | S--KDVVRKMKP-YWNKLLSSGLISQRKYNNLTKK--E---LTL | 912 |
| WP_002279025 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002279859 | IPQAFIKDNSIDNRVLTSSKENRG-KSDD--VP | 842 | S--KDVVRKMKS-YWSKLLSAKLITQRKFPDNLTKG--ERGGLTD | 910 |
| WP_002280230 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002281696 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002282247 | IPQAFIKDNSIDNRVLTSSKANRG-KSDD--VP | 847 | S--KDVVRKMKS-YWSKLLSAKLITQRKFPDNLTKK--E---LTL | 912 |
| WP_002282906 | IPQAFIKDNSIDNRVLTSSKENRG-KSDD--VP | 856 | S--EEVVHKMKP-FWSKLLSAKLITQRKFPDNLTKA--ERGGLTD | 924 |
| WP_002283846 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002287255 | IPQAFIKDNSIDNRVLTSSKENRG-KSDD--VP | 842 | S--KNVVRKMKS-YWSKLLSAKLITQRKFPDNLTKG--ERGGLTD | 910 |
| WP_002288990 | IPQAFIKDNSIDNRVLTSSKENRG-KSDD--VP | 842 | S--KNVVRKMKS-YWSKLLSAKLITQRKFPDNLTKA--ERGGLTD | 910 |
| WP_002289641 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002290427 | IPQAFIKDNSIDNRVLTSSKENRG-KSDD--VP | 842 | S--KDVVRKMKS-YWSKLLSAKLITQRKFPDNLTKG--ERGGLTD | 910 |
| WP_002295753 | IPQAFIKDNSIDNRVLTSSKENRG-KSDD--VP | 842 | S--KNVVRKMKS-YWSKLLSAKLITQRKFPDNLTKG--ERGGLTD | 910 |
| WP_002296423 | IPQAFIKDNSIDNRVLTSSKENRG-KSDD--VP | 842 | S--KNVVRKMKS-YWSKLLSAKLITQRKFPDNLTKG--ERGGLTD | 910 |
| WP_003044487 | IPQAFIKDNSIDNRVLTSSDKNRG-KSDD--VP | 842 | S--EEVVHKMKP-FWSKLLSAKLITQRKFPDNLTKA--ERGGLTD | 910 |
| WP_002305844 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_002307203 | IPQAFIKDNSIDNRVLTSSKENRG-KSDD--VP | 842 | S--KNVVRKMKS-YWSKLLSAKLITQRKFPDNLTKA--ERGGLTD | 910 |
| WP_002310390 | IPQAFIKDNSIDNRVLTSSKENRG-KSDD--VP | 842 | S--KNVVRKMKS-YWSKLLSAKLITQRKFPDNLTKG--ERGGLTD | 910 |
| WP_002352408 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_012997688 | IPQAFIKDNSIDNRVLTSSKENRG-KSDD--VP | 842 | S--KNVVRKMKS-YWSKLLSAKLITQRKFPDNLTKA--ERGGLTD | 910 |
| WP_014677909 | IPQAFIKDNSIDNRVLTSSKENRG-KSDD--VP | 842 | S--KDVVRKMKS-YWSKLLSAKLITQRKFPDNLTKA--ERGGLTD | 910 |
| WP_019312892 | IPQAFIKDNSIDNRVLTSSKENRG-KSDD--VP | 842 | S--KNVVRKMKS-YWSKLLSAKLITQRKFPDNLTKA--ERGGLTD | 910 |

| ID | | Sequence | | |
|---|---|---|---|---|
| WP_019313659 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019314093 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019315370 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_019803776 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_019805234 | 842 | IPQAFIKDNSIDNRVLTSSKENRG-KSDD--VP | S--KDVVRKMKS-YWSKLLSAKLITQRKFPDNLTKG--ERGGLTD | 910 |
| WP_024783594 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_024784288 | 847 | IPQAFIKDNSIDNRVLTSSKANRG-KSDD--VP | S--EDVVNRMRP-FWNKLLSSGLLISQRKYNNLTKK--E---LTL | 912 |
| WP_024784666 | 842 | IPQAFIKDNSIDNRVLTSSKENRG-KSDD--VP | S--KNVVRKMKS-YWSKLLSAKLITQRKFPDNLTKA--ERGGLTD | 910 |
| WP_024784894 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_024786433 | 847 | IPQAFIKDNSIDNRVLTSSKANRG-KSDD--VP | S--EDVVNRMRP-FWNKLLSSGLLISQRKYNNLTKK--E---LTL | 912 |
| WP_024786613 | 842 | IPQAFIKDNSIDNRVLTSSKENRG-KSDD--VP | S--KDVVRKMKP-YWSKLLSAKLITQRKFPDNLTKA--ERGGLTD | 910 |
| WP_049473442 | 842 | IPQAFIKDNSIDNRVLTSSKENRG-KSDD--VP | S--KDVVRKMKS-YWSKLLSAKLITQRKFPDNLTKA--ERGGLTD | 910 |
| WP_049474547 | 842 | IPQAFIKDNSIDNRVLTSSKENRG-KSDD--VP | S--KNVVRKMKS-YWSKLLSAKLITQRKFPDNLTKA--ERGGLTD | 910 |
| EMC03581 | 835 | IPQAFIKDNSIDNRVLTSSKENRG-KSDD--VP | S--LEVVERMKT-FWQQLLDSKLISYRKFPNNLTKA--ERGGLDE | 903 |
| WP_000428612 | 847 | VPQAFIKDDSLDNRVLTSLKDNRG-KSDN--VP | S--IEVVQKRKA-FWQQLLDSKLISERKFPNNLTKA--ERGGLDE | 915 |
| WP_000428613 | 845 | IPQAFIKDDSLDNRVLTSLKDNRG-KSDN--VP | S--IEVVERKMG-FWQQLLDSKLISERKFPNNLTKA--ERGGLDE | 913 |
| WP_049523028 | 840 | IPQAFIKDDSLDNRVLTSSKDNRG-KSDN--VP | S--LEIVERKMG-FWQQLLDSKLISERKFPNNLTKA--ERGGLDE | 908 |
| WP_003107102 | 811 | IPQSFIKDNSIDNIVLTSQESNRG-KSDN--VP | Y--IAIVNKMKS-YWQHQLKSGAISQRKFPDNLTKA--ERGGLSE | 879 |
| WP_054279288 | 843 | IPRSFIKDDSIDNKVLTRSEHNRG-KTDN--VP | S--IEVVKRMKP-YWQKLLFTKVISQRKFPDNLTKA--ERGGLQE | 911 |
| WP_049531101 | 845 | IPQAFIKDDSLDNRVLTSSKDNRG-KSDN--VP | S--LEVVQKRKA-FWQQLLESKLISERKFPNNLTKA--ERGGLNE | 913 |
| WP_049538452 | 845 | IPQAFIKDDSLDNRVLTSSKDNRG-KSDN--VP | C--LEVVDKMKV-FWQQLLDFKLISYRKFPNNLTKA--ERGGLDE | 913 |
| WP_049549711 | 845 | IPQAFIKDDSLDNRVLTSSKDNRG-KSDN--VP | S--LEVVQKRKA-FWQQLLDSKLISERKFPNNLTKAerERDGLNE | 915 |
| WP_007896501 | 847 | IPQSFIKDNSIDNLVLTQKANRG-KSDN--VP | S--IEVVRDMKDrYWRRQLANGAISRQKFPDHLTKA--ERGGLAD | 916 |
| EFR44625 | 799 | IPQSFIKDNSIDNIVLTQESNRG-KSDN--VP | S--IEVVRDMKDrYWRRQLANGAISRQKFPDNLTKA--ERGGLAD | 868 |
| WP_002974477 | 844 | IPQAFIKDDSLDNRVLTKSAKNRG-KSDN--VP | S--LEVVQKRKA-FWQQLLDSKLISERKFPNNLTKA--KRGGLDE | 912 |
| WP_002906454 | 845 | IPQAFIKDDSLDNRVLTKSAKNRG-KSDN--VP | S--IEVVDKMKV-FWQQLLDSKLISERKFPNNLTKA--ERGGLNE | 913 |
| WP_009729476 | 844 | IPQAFIKDDSLDNRVLTKSAKNRG-KSDN--VP | S--LEVVDKMKV-FWQQLLDSKLISERKFPNNLTKA--ERGGLNE | 912 |
| CQR24647 | 847 | IPQAFIKDDSLDNRVLTNSKSNRG-KSDN--VP | S--NEVVKRMKG-FWLKQLLDSKLISQRKFPDNLTKA--ERGGLSA | 917 |
| WP_000066813 | 845 | IPQAFIKDDSLDNRVLTSSKENRG-KSDN--VP | S--LEVVEKMKA-FWQQLLDSKLISERKFPNNLTKAerERGGLNE | 913 |
| WP_009754323 | 844 | IPQAFIKDDSLDNRVLTKSAKNRG-KSDN--VP | S--LEVVKKRKA-FWQQLLDSKLISERKFPNNLTKA--ERGGLDE | 912 |
| WP_044674937 | 846 | IPQAFIKDDSLDNKVLTKSAKNRG-KSDN--VP | S--LEIVHCKKN-FWKQLLDSQLISERKFPNNLTKA--ERGGLTN | 914 |
| WP_044676715 | 846 | IPQAFIKDDSLDNKVLTKSAKNRG-KSDN--VP | S--LEIVHCKKN-FWKQLLDSQLISERKFPNNLTKA--ERGGLTN | 914 |
| WP_044680361 | 844 | IPQAFIKDDSLDNKVLTKSAKNRG-KSDN--VP | S--LEIVHCKKN-FWKQLLDSQLISQRKFPDNLTKA--ERGGLTN | 912 |
| WP_044681799 | 844 | IPQAFIKDDSLDNKVLTKSAKNRG-KSDN--VP | S--LEIVHCKKN-FWKQLLDSQLISQRKFPDNLTKA--ERGGLTN | 912 |
| WP_049533112 | 841 | IPQAFIKDSFDNRVLTSSSENRG-KSDN--VP | S--IEVVRARKA-DWMRLRKAGLISQRKFPDNLTKA--ERGGLTE | 909 |
| WP_029090905 | 824 | LPQSYIKDNSIENLAVKKVENQR-KKDS11LN | S---SIINQNYS-RWEQLKNAGLIGEKKFPNLTRTk-----ITD | 890 |
| WP_006506696 | 850 | VPQSLVKDDSEDNRVLVPSENQR-KLDD1vVP | ---FDIRDKMYR-FWKLLFDHELISPKKFYSLIKTe----YTE | 916 |
| AIT42264 | 842 | VPQSFLKDSIDNRVLTSDKNRG-KSDN--VP | S--EEVVKKMKN-FWKLLNAKLITQRKFPDNLTKA--ERGGLSE | 910 |
| WP_034440723 | 849 | IPRSFITDNSEDNLVLTSSTVNRG-KLLDN--VP | Sp--DIVRQQKG-FWKQLLRAGLMSQRKFPNNLTKGk----LTD | 914 |
| AKQ21048 | 842 | VPQSFLKDDSIDNKVLTRSDKNRG-KSDN--VP | S--EEVVKKMKN-YWRQLLNAKLITQRKFPDNLTKA--ERGGLSE | 910 |
| WP_004636532 | 846 | IPQSFTTDNSIDNKVLVSRTKNQGnKSDD--VP | S--INIVHKMKP-FWRQLHKAGLISDRKFKNLTKA--BHGGLTE | 915 |
| WP_002364836 | 853 | IPQSFMKDDSLDNLVLVGSTENRG-KSDN--VP | S--KEVVKDMKA-YWEKLYAAGLISQRKFQRLITKG--EQGGLTL | 923 |
| WP_016631044 | 804 | IPQSFMKDDSLDNLVLVGSTENRG-KSDN--VP | S--KEVVKDMKA-YWEKLYAAGLISQRKFQRLITKG--EQGGLTL | 872 |
| EMS75795 | 589 | IPRSFIVDNSIDNKVLVLVGSTENRL-KMDD--VP | D--QKVVIRMRR-YWEKLRANLISERKFAYLTKLe---LTP | 654 |
| WP_002373311 | 853 | IPQSFMKDDSLDNLVLVGSTENRG-KSDN--VP | S--KKVVKKMKA-YWEKLYAAGLISQRKFQRLITKG--EQGGLTL | 921 |
| WP_002378009 | 853 | IPQSFMKDDSLDNLVLVGSTENRG-KSDN--VP | S--KEVVKDMKA-YWEKLYAAGLISQRKFQRLITKG--EQGGLTL | 921 |
| WP_002407324 | 853 | IPQSFMKDDSLDNLVLVGSTENRG-KSDN--VP | S--KEVVKDMKA-YWEKLYAAGLISQRKFQRLITKG--EQGGLTL | 921 |
| WP_002413717 | 853 | IPQSFMKDDSLDNLVLVGSTENRG-KSDN--VP | S--KEVVKDMKA-YWEKLYAAGLISQRKFQRLITKG--EQGGLTL | 921 |
| WP_010775580 | 855 | IPQSFMKDDSLDNLVLVGSTENRG-KSDN--VP | S--KEVVKDMKA-YWEKLYAAGLISQRKFQRLITKG--EQGGLTL | 923 |
| WP_010818269 | 853 | IPQSFMKDDSLDNLVLVGSTENRG-KSDN--VP | S--KEVVKDMKA-YWEKLYAAGLISQRKFQRLITKG--EQGGLTL | 921 |
| WP_010824395 | 853 | IPQSFMKDDSLDNLVLVGSTENRG-KSDN--VP | S--KEVVKDMKA-YWEKLYAAGLISQRKFQRLITKG--EQGGLTL | 921 |
| WP_016622645 | 853 | IPQSFMKDDSLDNLVLVGSTENRG-KSDN--VP | S--KEVVKKMKA-YWEKLYAAGLISQRKFQRLITKG--EQGGLTL | 921 |
| WP_033624816 | 853 | IPQSFMKDDSLDNLVLVGSTENRG-KSDN--VP | S--KEVVKKMKA-YWEKLYAAGLISQRKFQRLITKG--EQGGLTL | 921 |
| WP_033625576 | 853 | IPQSFMKDDSLDNLVLVGSTENRG-KSDN--VP | S--KEVVKKMKA-YWEKLYAAGLISQRKFQRLITKG--EQGGLTL | 921 |

| | | | | |
|---|---|---|---|---|
| WP_033789179 | 853 | IPQSFMKDDSLDNLVLVGSTENRG-KSDD--VP | S--KEVVKKMKA-YWEKLYAAGLISQRKFQRLTKG-EQGGLTL | 921 |
| WP_002310644 | 853 | IPRSFTTDNSIDNKVLVSSKENRL-KKDD--VP | S--BKVVKKMRS-FWYDLYSSKLISKRKLDNLTKIk------LTE | 918 |
| WP_002312694 | 854 | IPRSFTTDNSIDNKVLVSSKENRL-KKDD--VP | S--EKVVKKMRS-FWYDLYSSKLISKRKLDNLTKIk------LTE | 919 |
| WP_002314015 | 854 | IPRSFTTDNSIDNKVLVSSKENRL-KKDD--VP | S--EKVVKKMRS-FWYDLYSSKLISKRKLDNLTKIk------LTE | 919 |
| WP_002320716 | 854 | IPRSFTTDNSIDNKVLVSSKENRL-KKDD--VP | S--EKVVKKMRS-FWYDLYSSKLISKRKLDNLTKIk------LTE | 919 |
| WP_002330729 | 853 | IPRSFTTDNSIDNKVLVSSKENRL-KKDD--VP | S--EKVVKKMRS-FWYDLYSSKLISKRKLDNLTKIk------LTE | 918 |
| WP_002335161 | 854 | IPRSFTTDNSIDNKVLVSSKENRL-KKDD--VP | S--EKVVKKMRS-FWYDLYSSKLISKRKLDNLTKIk------LTE | 919 |
| WP_002345439 | 854 | IPRSFTTDNSIDNKVLVSSKENRL-KKDD--VP | S--BKVVKKMRS-FWYDLYSSKLISKRKLDNLTKIk------LTE | 919 |
| WP_034867970 | 845 | IPRSFIVDNSIDDKVLVASKQNQK-KRDD--VP | K--KQIVNEQRI-FWNQLKEAKLISTKKYAYLTKIe------LTP | 910 |
| WP_047937432 | 854 | IPRSFTTDNSIDNKVLVSSKENRL-KKDD--VP | S--EKVVKKMRS-FWYDLYSSKLISKRKLDNLTKIk------LTE | 919 |
| WP_010720994 | 845 | IPRSFIVDNSIDNKVLVASKQNQK-KRDD--VP | K--KQIVNEQRI-FWNQLKEAKLISPKKYAYLTKIe------LTP | 910 |
| WP_010737004 | 845 | IPRSFIVDNSIDNKVLVASKQNQK-KRDD--VP | K--KQIVNEQRI-FWNQLKEAKLISPKKYAYLTKIe------LTP | 910 |
| WP_034700478 | 845 | IPRSFIVDNSIDNKVLVASKQNQK-KRDD--VP | N--KQIVNEQRI-FWNQLKEAKLISPKKYAYLTKIe------LTP | 910 |
| WP_007209903 | 846 | IPQSFLTDNSIDNRVLTTSKSNRG-KSDN--VP | S--BEVVKRKMDR-FWRKLLNAKLISERKYTNLTKKe------LTE | 911 |
| WP_023519017 | 839 | IPRSFIVDNSLDNRVLVSSKVNRG-KLLDN-AP | D--PLVVKRMRS-HWEKLHQAKLISDKKLLANLTKQn------LTE | 904 |
| WP_010770040 | 846 | IPRSFIVDNSLDNRVLVSSKNRG-KLLDD--VP | S--KEVVQKNIT-LWETLKNSNLISQKKYDNLTKG--LRGGLTE | 914 |
| WP_048604708 | 843 | IPQSFIVDNSLDNRVLVSSSKNRG-KLLDD--VP | S--KEVVKKMRA-FWESLYRSGLLISKKFPDNLVKA--ESGGLSE | 911 |
| WP_010750235 | 848 | IPRSFIVDHSLDNKVLVSSKENRL-KKDD--VP | D--SKVVKRMKA-YWEKLLMAKLISERKFSYLTKLe------LTD | 913 |
| AII16583 | 881 | VPQSLLKDDSIDNKVLVLSSENQR-KLLD1vIP | ---EMIRNKMFG-FWNKLYENKIISPKKFYSLIKSe------YSD | 949 |
| WP_029073316 | 861 | VPQSLLKDDSIDNKVLVLSSENQR-KLLD1vIP | ---SSIRNKMYG-FWEKLFNNKIISPKKFYSLIKTe------FNE | 927 |
| WP_031589969 | 861 | IPQSFLKDDSIENKVLITKKENVR-KTNG--LP | S--EAVIQKMGS-FWKKLLDAGAWTNKKYDNLRFNI--HGGLNE | 902 |
| KDA45870 | 834 | LPRTYIPDDSLENKALVLAKENQR-KADD1lLN | S--NVIDKNLE-RWTYMLNNNMGLKKPKNLTRRv----ITD | 923 |
| AKP02966 | 857 | IPQSFLKDDSIDNLVLTSSAGNRE-KADQ--VP | S--VELGQKMQI-QWEQMLRAGLITKKKYDNLTNp--HGGLNE | 925 |
| WP_039099354 | 859 | VPQSFITDNLVLTSSAGNRE-KGDD--VP | P--LEIVRKRKV-FWEKLYQGNLMSKRKFPDYLTKA--ERGGLTE | 913 |
| WP_010991369 | 845 | VPQSFITDNLVLTSSAGNRE-KGDD--VP | P--LEIVRKRKV-FWEKLYQGNLMSKRKFPDYLTKA--ERGGLTE | 913 |
| WP_033838504 | 848 | IPQSFITDNSIDNLVLTSSAGNRE-KGND--VP | P--LEIVRKRKV-FWEKLYQGNLMSKRKFPDYLTKA--ERGGLTE | 916 |
| EHN60060 | 614 | VPQSFITDNSIDNLVLTSSAGNRE-KGND--VP | P--LEIVRKRKV-FWEKLYQGNLMSKRKFPDYLTKA--ERGGLTE | 682 |
| EFR89594 | 845 | IPQSFITDNRVLVSSTANRE-KGDN--VP | L--LEIVRKRKA-FWEKLYQAKLMSKRKFPDYLTKA--ERGGLTE | 913 |
| EFR95520 | 464 | IPQSFITDNRVLVSSTANRE-KGDN--VP | L--LEIVRKRKA-FWEKLYQAKLMSKRKFPDYLTKA--ERGGLTE | 532 |
| WP_003723650 | 845 | VPQSFITDNSIDNLVLTSSAGNRE-KGGD--VP | P--LEIVRKRKV-FWEKLYQGNLMSKRKFPDYLTKA--ERGGLTE | 913 |
| WP_003727705 | 845 | VPQSFITDNSIDNLVLTSSAGNRE-KGGD--VP | P--LEIVRKRKV-FWEKLYQGNLMSKRKFPDYLTKA--ERGGLTE | 913 |
| WP_003730785 | 845 | VPQSFITDNSIDNLVLTSSAGNRE-KGGD--VP | P--LEIVRKRKI-FWEKLYQGNLMSKRKFPDYLTKA--ERGGLTE | 913 |
| WP_003733029 | 845 | VPQSFITDNSVDNLVLTSSAGNRE-KGGD--VP | P--LEIVRKRKI-FWEKLFQGNLMSKRKFPDYLTKA--ERGGLTE | 913 |
| WP_003739838 | 845 | VPQSFITDNSIDNLVLTSSAGNRE-KGGD--VP | P--LEIVRKRKI-FWEKLYQGNLMSKRKFPDYLTKA--ERGGLTE | 913 |
| WP_014601172 | 845 | VPQSFITDNSIDNLVLTSSAGNRE-KGGD--VP | P--LEIVQKRKI-FWEKLYQGNLMSKRKFPDYLTKA--ERGGLTE | 913 |
| WP_003548323 | 845 | VPQSFITDNSIDNLVLTSSAGNRE-KGGD--VP | P--LEIVQKRKI-FWEKLYQGNLMSKRKFPDYLTKA--ERGGLTD | 913 |
| WP_031665337 | 845 | VPQSFITDNSIDNLVLTSSAGNRE-KGGD--VP | P--LEIVQKRKI-FWEKLYQGNLMSKRKFPDYLTKA--ERGGLTE | 913 |
| WP_031669209 | 845 | VPQSFITDNSIDNLVLTSSAGNRE-KGGD--VP | P--LEIVQKRKI-FWEKLYQGNLMSKRKFPDYLTKA--ERGGLTE | 913 |
| WP_033920898 | 848 | VPQSFITDNSIDNLVLTSSAGNRE-KGGD--VP | P--LEIVRKRKV-FWEKLYQGNLMSKRKFPDYLTKA--ERGGLTD | 916 |
| AKI42028 | 848 | VPQSFITDNSIDNLVLTSSAGNRE-KGGD--VP | P--LEIVRKRKV-FWEKLYQGNLMSKRKFPDYLTKA--ERGGLTE | 916 |
| AKI50529 | 293 | VPQSFITDNSIDNLVLTSSAANRE-KGDD--VP | P--LEIVRKRKV-YWEKLYQAKLMSKRKFPDYLTKA--ERGGLTE | 361 |
| EFR83390 | 845 | VPQSFLKDDSIDNRVLASSAANRE-KGDD--VP | P--LEIVRKRKV-YWEKLYQAKLMSKRKFPDYLTKA--ERGGLTE | 913 |
| WP_046323366 | 858 | VPQSFLKDDSIDNRVLTRSDKNRG-KSDN--VP | S--EEVVKKMKN-YWRQLLNAKLITQRKFPDNLTKA--ERGGLSE | 926 |
| AKE81011 | 854 | VPQSFLKDDSIDNRVLLPSENQR-KLLD1vVP | ---FDIRDKMYR-FWKLLFDHELISPKKFYSLIKTe----YTE | 920 |
| CUO82355 | 856 | LPQSLIKDDSFDNRVLVLPEENQW-KLDSetVP | ---FEIRNKMIG-FWQMLHENGLMSNKPFSLIRTd----FSD | 922 |
| WP_033162887 | 875 | VPQSFLKDDSIDNRVLTRSDKNRG-KSDN--VP | S--EEVVKKMKN-YWRQLLNAKLITQRKFPDNLTKA--ERGGLSE | 943 |
| AGZ01981 | 842 | VPQSFLKDDSIDNKVLITRSDKNRG-KSDN--VP | S--EEVVKKMKN-YWRQLLNAKLITQRKFPDNLTKA--ERGGLSE | 910 |
| AKA60242 | 842 | VPQSFLKDDSIDNKVLITRSDKNRG-KSDN--VP | S--EEVVKKMKN-YWRQLLNAKLITQRKFPDNLTKA--ERGGLSE | 910 |
| AKS40380 | 846 | VPQSFLKDDSIDNKVLITRSDKNRG-KSDN--VP | S--EEVVKKMKN-YWRQLLNAKLITQRKFPDNLTKA--ERGGLSE | 914 |
| 4UN5_B | 846 | VPQSFLKDDSIDNKVLITRSDKNRG-KSDN--VP | S--EEVVKKMKN-YWRQLLNAKLITQRKFPDNLTKA--ERGGLSE | 914 |

| ID | | | | | |
|---|---|---|---|---|---|
| WP_010922251 | 911 | LD | KAGFIKRQLVETRQITKHVAQILDSRMNTKYDENDKLIR--EVKVITLKSKLVSDFRKDF | QFYKVREINNY | 981 |
| WP_039695303 | 921 | AD | KAGFIKRQLVETRQITKHVAQILDSRMNTKYDENDKVIR--DVKVITLKSNLVSQFRKDF | EFYKVREINDY | 991 |
| WP_045635197 | 913 | RD | KVGFIKRQLVETRQITKHVAQILDARYNTEVNEKDKKNR--ITVKIITLKSNLVSNERKEF | RLYKVREINDY | 983 |
| 5AXW_A | 633 | RD | QKDFINRNLVDITRYATRGLMNLLRSYFR-------VNnlDVKVKSINGGFTSFLRRKW | KFKKERNKGYK | 702 |
| WP_009880683 | 595 | LD | KAGFIKRQLVETRQITKHVAQILDSRMNTKYDENDKLIR--EVRVITLKSKLVSDERKDF | QFYKVREINNY | 665 |
| WP_010922251 | 911 | LD | KVGFIKRQLVETRQITKHVAQILDSRMNTKYDENDKLIR--EVRVITLKSKLVSDERKDF | QFYKVREINNY | 981 |
| WP_011054416 | 911 | LD | KVGFIKRQLVETRQITKHVAQILDSRMNTKYDENDKLIR--EVRVITLKSKLVSDERKDF | QFYKVREINNY | 981 |
| WP_011284745 | 911 | LD | KAGFIKRQLVETRQITKHVAQILDSRMNTKYDENDKLIR--EVRVITLKSKLVSDERKDF | QFYKVREINNY | 981 |
| WP_011285506 | 911 | LD | KAGFIKRQLVETRQITKHVAQILDSRMNTKYDENDKLIR--EVRVITLKSKLVSDERKDF | QFYKVREINNY | 981 |
| WP_011527619 | 911 | LD | KAGFIKRQLVETRQITKHVAQILDSRMNTKYDENDKLIR--EVRVITLKSKLVSDERKDF | QFYKVREINNY | 981 |
| WP_012560673 | 911 | LD | KAGFIKRQLVETRQITKHVAQILDSRMNTKYDENDKLIR--EVRVITLKSKLVSDERKDF | QFYKVREINNY | 981 |
| WP_014407541 | 910 | LD | KAGFIKRQLVETRQITKHVAQILDSRMNTKYDENDKLIR--EVRVITLKSKLVSDERKDF | QFYKVREINNY | 980 |
| WP_020905136 | 911 | LD | KAGFIKRQLVETRQITKHVAQILDSRMNTKYDENDKLIR--EVRVITLKSKLVSDERKDF | QFYKVREINNY | 981 |
| WP_023080005 | 910 | LD | KAGFIKRQLVETRQITKHVAQILDSRMNTKYDENDKLIR--EVRVITLKSKLVSDERKDF | QFYKVREINNY | 980 |
| WP_023610282 | 910 | LD | KAGFIKRQLVETRQITKHVAQILDSRMNTKYDENDKLIR--EVRVITLKSKLVSDERKDF | QFYKVREINNY | 980 |
| WP_030125963 | 911 | LD | KAGFIKRQLVETRQITKHVAQILDSRMNTKYDENDKLIR--EVKVITLKSKLVSDERKDF | QFYKVREINNY | 981 |
| WP_030126706 | 911 | LD | KAGFIKRQLVETRQITKHVAQILDSRMNTKYDENDKLIR--EVKVITLKSKLVSDERKDF | QFYKVREINNY | 981 |
| WP_031488318 | 911 | LD | KAGFIKRQLVETRQITKHVAQILDSRMNTKYDENDKLIR--EVKVITLKSKLVSDERKDF | QFYKVREINNY | 981 |
| WP_032460140 | 911 | LD | KAGFIKRQLVETRQITKHVAQILDSRMNTKYDENDKLIR--EVRVITLKSKLVSDERKDF | QFYKVREINNY | 981 |
| WP_032461047 | 911 | LD | KAGFIKRQLVETRQITKHVAQILDSRMNTKYDENDKLIR--EVRVITLKSKLVSDERKDF | QFYKVREINNY | 981 |
| WP_032462016 | 911 | LD | KAGFIKRQLVETRQITKHVAQILDSRMNTKYDENDKLIR--EVRVITLKSKLVSDERKDF | QFYKVREINNY | 981 |
| WP_032462936 | 911 | LD | KAGFIKRQLVETRQITKHVAQILDSRMNTKYDENDKLIR--EVRVITLKSKLVSDERKDF | QFYKVREINNY | 981 |
| WP_032464890 | 911 | LD | KAGFIKRQLVETRQITKHVAQILDSRMNTKYDENDKLIR--EVRVITLKSKLVSDERKDF | QFYKVREINNY | 981 |
| WP_033888930 | 736 | LD | KAGFIKRQLVETRQITKHVAQILDSRMNTKYDENDKLIR--EVKVITLKSKLVSDERKDF | QFYKVREINNY | 806 |
| WP_038431314 | 911 | LD | KAGFIKRQLVETRQITKHVAQILDSRMNTKYDENDKLIR--EVKVITLKSKLVSDERKDF | QFYKVREINNY | 981 |
| WP_038432938 | 910 | LD | KAGFIKRQLVETRQITKHVAQILDSRMNTKYDENDKLIR--EVKVITLKSKLVSDERKDF | QFYKVREINNY | 980 |
| WP_038434062 | 911 | LD | KAGFIKRQLVETRQITKHVAQILDSRMNTKYDENDKLIR--EVRVITLKSKLVSDERKDF | QFYKVREINNY | 981 |
| BAQ51233 | 822 | LD | KAGFIKRQLVETRQITKHVAQILDSRMNTKYDENDKLIR--EVRVITLKSKLVSDERKDF | QFYKVREINNY | 892 |
| KGE60162 | 86 | LD | KVGFIKRQLVETRQITKHVAQILDSRMNTKYDENDKLIR--EVRVITLKSKLVSDERKDF | QFYKVREINNY | 156 |
| KGE60856 | | -- | ------------------------------------------------------------ | ----------- | |
| WP_002989955 | 911 | LD | KAGFIKRQLVETRQITKHVAQILDDERFNTEFPDGNKRRIR--NVKIITLKSNLVSNFRKEF | QFYKVREINNY | 981 |
| WP_003030002 | 910 | ED | KAGFIKRQLVETRQITKHVAQILDERFNTEFPDGNKRRIR--NVKIITLKSNLVSNFRKEF | ELYKVREINDY | 980 |
| WP_003065552 | 921 | AD | KARFIQRQLVETRQITKHVAQIIDDARFNTESDENDKVIR--DVKVITLKSNLVSQFRKDF | EFYKVREINDY | 991 |
| WP_001040076 | 916 | DD | KARFIQRQLVETRQITKHVARIILDERFNNELDSKGRRIR--KVKIVTLKSNLVSNFRKEF | VFYKIREVNDY | 986 |
| WP_001040078 | 916 | DD | KARFIQRQLVETRQITKHVARIILDERFNNELDSKGRRIR--KVKIVTLKSNLVSNFRKEF | GFYKIREVNDY | 986 |
| WP_001040080 | 916 | DD | KARFIQRQLVETRQITKHVARIILDERFNNELDSKGRRIR--KVKIVTLKSNLVSNFRKEF | GFYKIREVNNY | 986 |
| WP_001040081 | 916 | DD | KARFIQRQLVETRQITKHVARIILDERFNNELDSKGRRIR--KVKIVTLKSNLVSNFRKEF | GFYKIREVNNY | 986 |
| WP_001040083 | 916 | DD | KARFIQRQLVETRQITKHVARIILDERFNNELDSKGRRIR--KVKIVTLKSNLVSNFRKEF | GFYKIREVNNY | 986 |
| WP_001040085 | 916 | DD | KARFIQRQLVETRQITKHVARIILDERFNNELDSKGRRIR--KVKIVTLKSNLVSNFRKEF | GFYKIREVNNY | 986 |
| WP_001040087 | 916 | DD | KARFIQRQLVETRQITKHVARIILDERFNNELDSKGRRIR--KVKIVTLKSNLVSNFRKEF | GFYKIREVNNY | 986 |
| WP_001040088 | 916 | DD | KARFIQRQLVETRQITKHVARIILDERFNNELDSKGRRIR--KVKIVTLKSNLVSNFRKEF | GFYKIREVNNY | 986 |
| WP_001040089 | 916 | DD | KARFIQRQLVETRQITKHVARIILDERFNNELDSKGRRIR--KVKIVTLKSNLVSNFRKEF | GFYKIREVNNY | 986 |
| WP_001040090 | 916 | DD | KARFIQRQLVETRQITKHVARIILDERFNNELDSKGRRIR--KVKIVTLKSNLVSNFRKEF | GFYKIREVNNY | 986 |
| WP_001040091 | 916 | DD | KARFIQRQLVETRQITKHVARIILDERFNNELDSKGRRIR--KVKIVTLKSNLVSNFRKEF | GFYKIREVNNY | 986 |
| WP_001040092 | 916 | DD | KARFIQRQLVETRQITKHVARIILDERFNNELDSKGRRIR--KVKIVTLKSNLVSNFRKEF | GFYKIREVNNY | 986 |
| WP_001040094 | 916 | DD | KARFIQRQLVETRQITKHVARIILDERFNNKVDDNNKPIR--KVKIVTLKSNLVSNFRKEF | GFYKIREVNNY | 986 |
| WP_001040095 | 916 | DD | KARFIQRQLVETRQITKHVARIILDERFNNELDSKGRRIR--KVKIVTLKSNLVSNFRKEF | GFYKIREVNNY | 986 |
| WP_001040096 | 916 | DD | KARFIQRQLVETRQITKHVARIILDERFNNELDSKGRRIR--KVKIVTLKSNLVSNFRKEF | GFYKIREVNNY | 986 |
| WP_001040097 | 916 | DD | KARFIQRQLVETRQITKHVARIILDERFNNELDSKGRRIR--KVKIVTLKSNLVSNFRKEF | GFYKIREVNNY | 986 |
| WP_001040098 | 916 | DD | KARFIQRQLVETRQITKHVARIILDERFNNELDSKGRRIR--KVKIVTLKSNLVSNFRKEF | GFYKIREVNNY | 986 |
| WP_001040099 | 916 | DD | KARFIQRQLVETRQITKHVARIILDERFNNELDSKGRRIR--KVKIVTLKSNLVSNFRKEF | GFYKIREVNNY | 986 |

| Name | Pos | Seq1 | Seq2 | Seq3 | End |
|---|---|---|---|---|---|
| WP_001040100 | 916 | DD | KARFIQRQLVETRQITKHVARILDERFNNELDSKGRRIR--KVKIVTLKSNLVSNFRKEF | GFYKIREVNNY | 986 |
| WP_001040104 | 916 | DD | KARFIQRQLVETRQITKHVARILDERFNNELDSKGRRIR--KVKIVTLKSNLVSNFRKEF | GFYKIREVNNY | 986 |
| WP_001040105 | 916 | DD | KARFIQRQLVETRQITKHVARILDERFNNELDSKGRRIR--KVKIVTLKSNLVSNFRKEF | GFYKIREVNNY | 986 |
| WP_001040106 | 916 | DD | KARFIQRQLVETRQITKHVARILDERFNNELDSKGRRIR--KVKIVTLKSNLVSNFRKEF | GFYKIREVNDY | 986 |
| WP_001040107 | 916 | DD | KARFIQRQLVETRQITKHVARILDERFNNELDSKGRRIR--KVKIVTLKSNLVSNFRKEF | GFYKIREVNNY | 986 |
| WP_001040108 | 916 | DD | KARFIQRQLVETRQITKHVARILDERFNNELDSKGRRIR--KVKIVTLKSNLVSNFRKEF | GFYKIREVNNY | 986 |
| WP_001040109 | 916 | DD | KARFIQRQLVETRQITKHVARILDERFNNELDSKGRRIR--KVKIVTLKSNLVSNFRKEF | GFYKIREVNDY | 986 |
| WP_001040110 | 916 | DD | KARFIQRQLVETRQITKHVARILDERFNNELDSKGRRIR--KVKIVTLKSNLVSNFRKEF | GFYKIREVNNY | 986 |
| WP_015058523 | 916 | DD | KARFIQRQLVETRQITKHVARILDERFNNELDSKGRRIR--KVKIVTLKSNLVSNFRKEF | GFYKIREVNNY | 986 |
| WP_017643650 | 916 | DD | KARFIQRQLVETRQITKHVARILDERFNNELDSKGRRIR--KVKIVTLKSNLVSNFRKEF | GFYKIREVNNY | 986 |
| WP_017647151 | 916 | DD | KARFIQRQLVETRQITKHVARILDERFNNELDSKGRRIR--KVKIVTLKSNLVSNFRKEF | GFYKIREVNNY | 986 |
| WP_017648376 | 916 | DD | KARFIQRQLVETRQITKHVARILDERFNNELDSKGRRIR--KVKIVTLKSNLVSNFRKEF | GFYKIREVNNY | 986 |
| WP_017649527 | 916 | DD | KARFIQRQLVETRQITKHVARILDERFNNELDSKGRRIR--KVKIVTLKSNLVSNFRKEF | GFYKIREVNNY | 986 |
| WP_017771611 | 916 | DD | KARFIQRQLVETRQITKHVARILDERFNNELDSKGRRIR--KVKIVTLKSNLVSNFRKEF | GFYKIREVNNY | 986 |
| WP_017771984 | 916 | DD | KARFIQRQLVETRQITKHVARILDERFNNELDSKGRRIR--KVKIVTLKSNLVSNFRKEF | GFYKIREVNNY | 986 |
| CFQ25032 | 916 | DD | KARFIQRQLVETRQITKHVARILDERFNNELDSKGRRIR--KVKIVTLKSNLVSNFRKEF | GFYKIREVNNY | 986 |
| CFV16040 | 916 | DD | KARFIQRQLVEIRQITKHVARILDERFNNELDSKGRRIR--KVKIVTVKSNLVSNFRKEF | GFYKIREVNNY | 986 |
| KLJ37842 | 916 | DD | KARFIQRQLVETRQITKHVARIDELFNNELDSKGRRIR--KVKIVTLKSNLVSNFRKEF | GFYKIREVNNY | 986 |
| KLJ72361 | 930 | DD | KARFIQRQLVETRQITKHVARILDERFNNELDSKGRRIR--KVKIVTLKSNLVSNFRKEF | GFYKIREVNNY | 1000 |
| KLL20707 | 916 | DD | KARFIQRQLVETRQITKHVARILDERFNNELDSKGRRIR--KVKIVTLKSNLVSNFRKEF | GFYKIREVNNY | 986 |
| KLL42645 | 916 | DD | KARFIQRQLVETRQITKHVARILDERFNNELDSKGRRIR--KVKIVTLKSNLVSNFRKEF | GFYKIREVNDY | 986 |
| WP_047207273 | 916 | DD | KARFIQRQLVETRQITKHVARILDERFNNELDSKGRRIR--KVKIVTLKSNLVSNFRKEF | GFYKIREVNNY | 986 |
| WP_047209694 | 916 | DD | KARFIQRQLVETRQITKHVARILDERFNNELDSKGRRIR--KVKIVTLKSNLVSNFRKEF | GFYKIREVNNY | 986 |
| WP_050198062 | 916 | DD | KARFIQRQLVETRQITKHVARILDERFNNELDSKGRRIR--KVKIVTLKSNLVSNFRKEF | GFYKIREVNNY | 986 |
| WP_050201642 | 916 | DD | KARFIQRQLVETRQITKHVARIASIIDERFNNELDSKGRRIR--KVKIVTLKSNLVSNFRKEF | GFYKIREVNNY | 986 |
| WP_050204027 | 916 | DD | KARFIQRQLVETRQITKHVARILDERFNNELDSKGRRIR--KVKIVTLKSNLVSNFRKEF | GFYKIREVNNY | 986 |
| WP_050881965 | 916 | DD | KARFIQRQLVETRQITKHVARILDERFNNKLDSKGRRIR--KVKIVTLKSNLVSNFRKEF | GFYKIREVNNY | 986 |
| WP_050886065 | 916 | DD | KARFIQRQLVETRQITKHVARILDERFNNELDSKGRRIR--KVKIVTLKSNLVSNFRKEF | GFYKIREVNNY | 986 |
| AHN30376 | 916 | DD | KARFIQRQLVETRQITKHVARILDERFNNKVDDNNKPIR--KVKIVTLKSNLVSNFRKEF | GFYKIREVNNY | 986 |
| EA078426 | 916 | DD | KARFIQRQLVETRQITKHVARILDERFNNELDSKGRRIR--KVKIVTLKSNLVSNFRKEF | GFYKIREVNNY | 986 |
| CCW42055 | 910 | ND | KARFIKRQLVETRQITKHVAQVLDARFNAKHDENKKVIR--DVKIITLKSNLVSNFRKDF | KFYKVREINDY | 980 |
| WP_003041502 | 911 | ED | KAGFIKRQLVETRQITKHVAQILDERFNTEFDGAQRRIR--NVKIITLKSNLVSNFRKEF | ELYKVREINDY | 981 |
| WP_037593752 | 911 | ED | KAGFIKRQLVETRQITKHVAQILDERFNTEFDGAQRRIR--NVKIITLKSNLVSNFRKEF | ELYKVREINDY | 981 |
| WP_049516684 | 910 | ED | KAGFIKRQLVETRQITKHVAQILDERFNTEFPDGAQRRIR--NVKIITLKSNLVSQFRKEF | KFYKVREINDY | 980 |
| GAD46167 | 919 | AD | KAGFIKRQLVETRQITKHVAQILDARFNTERDENDKVIR--EVKIVTLKSKLVSQFRKDF | KFYKVREINDY | 989 |
| WP_018363470 | 920 | AD | KAGFIKRQLVETRQITKHVAQILDSRMNTKRDKNDKPIR--EVKIVTLKSKLVSQFRKDF | QLYKVRDINNY | 990 |
| WP_003043819 | 910 | ED | KAGFIKRQLVETRQITKHVAQILDSRMNTKRDENDKVIR--EVKIVTLKSKLVSQFRKDF | KFYKVREINNY | 989 |
| WP_006269658 | 910 | ED | KAGFIHRQLVETRQITKHVAQILDARFNPKRDDNKKVIR--DVKIITLKSKLVSDFRKDF | ELYKVREINDY | 980 |
| WP_048800889 | 910 | ND | KAGFIKRQLVETRQITKHVAQILDSRMNTKYDENDKLIR--DVKIITLKSKLVSDFRKDF | KLYKVREINNY | 980 |
| WP_012767106 | 910 | LD | KAGFIKRQLVETRQITKHVAQILDSRMNTKYDENDKLIR--EVKIITLKSKLVSDFRKDF | QFYKVREINNY | 980 |
| WP_014612333 | 910 | LD | KAGFIKRQLVETRQITKHVAQILDSRMNTKYDENDKLIR--EVKIITLKSKLVSDFRKDF | QFYKVREINNY | 980 |
| WP_015017095 | 910 | LD | KAGFIKRQLVETRQITKHVAQILDSRMNTKYDENDKLIR--EVKIITLKSKLVSDFRKDF | QFYKVREINNY | 980 |
| WP_015057649 | 910 | LD | KAGFIKRQLVETRQITKHVAQILDSRMNTKYDENDKLIR--EVKIITLKSKLVSDFRKDF | QFYKVREINNY | 980 |
| WP_048327215 | 910 | LD | KAGFIKRQLVETRQITKHVAQILDARFNTKCDENDKVIR--EVKIITLKSKLVSQFRKDF | GLYKIRDINHY | 980 |
| WP_049519324 | 910 | LD | KAGFIKRQLVETRQITKHVAQILDARFNTKCDENDKVIR--EVKIITLKSKLVSQFRKDF | GLYKIRDINHY | 980 |
| WP_012515931 | 910 | VD | KAGFIKRQLVETRQITKHVAQILDSRFNTEFDDHNKRIR--KVHIITLKSKLVSNFRKDF | GLYKIRDINHY | 980 |
| WP_021320964 | 910 | VD | KAGFIKRQLVETRQITKHVAQILDSRFNTEFDDHNKRIR--KVHIITLKSKLVSNFRKDF | GLYKIRDINHY | 980 |
| WP_037581760 | 910 | VD | KAGFIQLQLVETRQITKHVAQILDARFNTEFDDHNKRIR--KVHHIITLKSKLVSNFRKDF | GLYKIRDINHY | 980 |
| WP_004232481 | 918 | TD | KAGFIKRQLVETRQITKHVAQILDARFNTKCDENDKVIR--DVKIITLKSKLVSQFRKDF | KFYKVREINDY | 988 |
| WP_009854540 | 919 | AD | KAGFIKRQLVETRQITKHVAQILDARFNTEHDENDKVIR--NVKVITLKSNLVSNFRKDF | EFYKVREINDY | 989 |
| WP_012962174 | 919 | ND | KAGFIKRQLVETRQITKHVAQILDARFNTERDENDKVIR--DVKVITLKSNLVSQFRKDF | EFYKVREINDY | 989 |
| WP_039695303 | 921 | AD | KAGFIKRQLVETRQITKHVAQILDARFNTKRDENDKVIR--DVKIITLKSNLVSNFRKDF | KFYKVREINDY | 991 |
| WP_014334983 | 918 | AD | KAGFIKRQLVETRQITKHVAQILDARFNTKRDENDKVIR--DVKIITLKSNLVSNFRKDF | KFYKVREINDY | 988 |

| | | | | |
|---|---|---|---|---|
| WP_003099269 | 911 | KAGFIKRQLVETRQITKHVAQILDSRFNSNLTEDSKSNR--NVKIITLKSKMVSDFRKDF | FD | GFYKLREVNDY | 981 |
| AHYI5608 | 911 | KAGFIKRQLVETRQITKHVAQILDSRFNSNLTEDSKSNR--NVKIITLKSKMVSDFRKDF | FD | GFYKLREVNDY | 981 |
| AHY17476 | 911 | KAGFIKRQLVETRQITKHVAQILDSRFNSNLTEDSKSNR--NVKIITLKSKMVSDFRKDF | FD | GFYKLREVNDY | 981 |
| ESR09100 | | ------------------------------------------------------------ | -- | ----------- | |
| AGM98575 | 911 | KAGFIKRQLVETRQITKHVAQILDSRFNSNLTEDSKSNR--NVKIITLKSKMVSDFRKDF | FD | GFYKLREVNDY | 981 |
| ALF27331 | 911 | KAGFIKRQLVETRQITKHVARILDERFNTETDENNKIR--QVKIVTLKSNLVSNFRKEF | DD | ELYKLREVNDY | 981 |
| WP_018372492 | 924 | KAGFIKRQLVETRQITKHVARLLDEKLNRKKNENGEKLR--TTKIITLKSVFASRFRANF | ED | DLYKLRELNHY | 994 |
| WP_045618028 | 911 | KAGFIKRQLVETRQITKHVARILDARFNTEVTEKDKKDR--SVKIITLKSNLVSNFRKEF | DD | RLYKVREINDY | 981 |
| WP_045635197 | 914 | KVGFIKRQLVETRQITKHVAQILDARYNTEVNEKDKKNR--TVKIITLKSNLVSNFRKEF | RD | RLYKVREINDY | 984 |
| WP_002263549 | 913 | KVGFIKRQLVETRQITKHVAQILDARYNTEVNEKDKKNR--TVKIITLKSNLVSNFRKEF | RD | ELYKVREINDY | 983 |
| WP_002263887 | 911 | KAGFIKRQLVETRQITKHVARILDERFNTETDENNKKIR--QVKIVTLKSNLVSNFRKEF | DD | ELYKVREINDY | 981 |
| WP_002264920 | 911 | KAGFIKRQLVETRQITKHVARILDERFNTETDENNKKIR--QVKIVTLKSNLVSNFRKEF | DD | ELYKVREINDY | 981 |
| WP_002269043 | 911 | KAGFIKRQLVETRQITKHVARILDERFNTETDENNKKIR--QVKIVTLKSNLVSNFRKEF | DD | ELYKVREINDY | 981 |
| WP_002269448 | 911 | KAGFIKRQLVETRQITKHVARILDERFYTETDENNKKIR--QVKIVTLKSNLVSNFRKEF | DD | ELYKVREINDY | 981 |
| WP_002271977 | 911 | KAGFIKRQLVETRQITKHVARILDERFYTETDENNKKIR--QVKIVTLKSNLVSNFRKEF | DD | ELYKVREINDY | 981 |
| WP_002272766 | 911 | KAGFIKRQLVETRQITKHVARILDERFNTETDENNKKIR--QVKIVTLKSNLVSNFRKEF | DD | ELYKVREINDY | 981 |
| WP_002273241 | 911 | KAGFIKRQLVETRQITKHVARILDERFNTETDENNKKIR--QVKIVTLKSNLVSNFRKEF | DD | ELYKVREINDY | 981 |
| WP_002275430 | 911 | KAGFIKRQLVETRQITKHVARILDERFHTETDENNKKIR--QVKIVTLKSNLVSNFRKEF | DD | ELYKVREINDY | 981 |
| WP_002276448 | 911 | KAGFIKRQLVETRQITKHVARILDERFNTETDENNKKIR--QVKIVTLKSNLVSNFRKEF | DD | ELYKVREINDY | 981 |
| WP_002277050 | 913 | KAGFIKRQLVETRQITKHVARMLDERFNKEFDDNNKRIR--RVKIVTLKSNLVSSFRKEF | DD | ELYKVREINDY | 983 |
| WP_002277364 | 911 | KAGFIKRQLVETRQITKHVARILDERFHTETDENNKKIR--QVKIVTLKSNLVSNFRKEF | DD | ELYKVREINDY | 981 |
| WP_002279025 | 911 | KAGFIKRQLVETRQITKHVARILDERFNTETDENNKKIR--QVKIVTLKSNLVSNFRKEF | DD | ELYKVREINDY | 981 |
| WP_002279859 | 911 | KAGFIKRQLVETRQITKHVARILDERFYTETDENNKKIR--QVKIVTLKSNLVSNFRKEF | DD | ELYKVREINDY | 981 |
| WP_002280230 | 911 | KAGFIKRQLVETRQITKHVARILDERFNTETDENNKKIR--QVKIVTLKSNLVSNFRKEF | DD | ELYKVREINDY | 981 |
| WP_002281696 | 911 | KAGFIKRQLVETRQITKHVARILDERFNTETDENNKKIR--QVKIVTLKSNLVSNFRKEF | DD | ELYKVREINDY | 981 |
| WP_002282247 | 913 | KAGFIKRQLVETRQITKHVARMLDERFNKEFDDNNKRIR--RVKIVTLKSSFVSNFRKEF | DD | ELYKVREINDY | 983 |
| WP_002282906 | 911 | KAGFIKRQLVETRQITKHVARILDERFNTETDENNKKIR--QVKIVTLKSNLVSNFRKEF | DD | ELYKVREINDY | 981 |
| WP_002283846 | 911 | KAGFIKRQLVETRQITKHVARILDERFNTETDENNKKIR--QVKIVTLKSNLVSNFRKEF | DD | ELYKVREINDY | 981 |
| WP_002287255 | 911 | KAGFIKRQLVETRQITKHVARILDERFNTETDENNKKIR--QVKIVTLKSNLVSNFRKEF | DD | ELYKVREINDY | 981 |
| WP_002288990 | 911 | KAGFIKRQLVETRQITKHVARILDERFNTETDENNKKIR--QVKIVTLKSNLVSNFRKEF | DD | ELYKVREINDY | 981 |
| WP_002289641 | 911 | KAGFIKRQLVETRQITKHVARILDERFNTETDENNKKIR--QVKIVTLKSNLVSNFRKEF | DD | ELYKVREINDY | 981 |
| WP_002290427 | 911 | KAGFIKRQLVETRQITKHVARILDERFYTETDENNKKIR--QVKIVTLKSNLVSNFRKEF | DD | ELYKVREINDY | 981 |
| WP_002295753 | 911 | KAGFIKRQLVETRQITKHVARILDERFNTETDENNKKIR--QVKIVTLKSNLVSNFRKEF | DD | ELYKVREINDY | 981 |
| WP_002296423 | 911 | KAGFIKRQLVETRQITKHVARILDERFHTETDENNKKIR--QVKIVTLKSNLVSNFRKEF | DD | ELYKVREINDY | 981 |
| WP_003304487 | 925 | KAGFIKRQLVETRQITKHVARILDERFNTETDENNKKIR--QVKIVTLKSNLVSNFRKEF | DD | ELYKVREINDY | 995 |
| WP_002305844 | 911 | KAGFIKRQLVETRQITKHVARILDERFNTETDENNKKIR--QVKIVTLKSNLVSNFRKEF | DD | ELYKVREINDY | 981 |
| WP_002307203 | 911 | KAGFIKRQLVETRQITKHVARILDERFNTETDENNKKIR--QVKIVTLKSNLVSNFRKEF | DD | ELYKVREINDY | 981 |
| WP_002310390 | 911 | KAGFIKHQLVETRQITKHVARILDERFHTETDENNKKIR--QVKIVTLKSNLVSNFRKEF | DD | ELYKVREINDY | 981 |
| WP_003352408 | 911 | KAGFIKRQLVETRQITKHVARILDERFNTETDENNKKIR--QVKIVTLKSNLVSNFRKEF | DD | ELYKVREINDY | 981 |
| WP_012997688 | 911 | KAGFIKRQLVETRQITKHVARILDERFNTETDENNKKIR--QVKIVTLKSNLVSNFRKEF | DD | ELYKVREINDY | 981 |
| WP_014677909 | 911 | KAGFIKRQLVETRQITKHVARILDERFNTETDENNKKIR--QVKIVTLKSNLVSNFRKEF | DD | ELYKVREINDY | 981 |
| WP_019312892 | 911 | KAGFIKRQLVETRQITKHVARILDERFNTETDENNKKIR--QVKIVTLKSNLVSNFRKEF | DD | ELYKVREINDY | 981 |
| WP_019313659 | 911 | KAGFIKRQLVETRQITKHVARILDERFNTETDENNKKIR--QVKIVTLKSNLVSNFRKEF | DD | ELYKVREINDY | 981 |
| WP_019314093 | 911 | KAGFIKRQLVETRQITKHVARILDERFNTETDENNKKIR--QVKIVTLKSNLVSNFRKEF | DD | ELYKVREINDY | 981 |
| WP_019315370 | 911 | KAGFIKRQLVETRQITKHVARILDERFNTETDENNKKIR--QVKIVTLKSNLVSNFRKEF | DD | ELYKVREINDY | 981 |
| WP_019803776 | 911 | KAGFIKRQLVETRQITKHVARILDERFNTETDENNKKIR--QVKIVTLKSNLVSNFRKEF | DD | ELYKVREINDY | 981 |
| WP_019805234 | 911 | KAGFIKRQLVETRQITKHVARILDERFNTETDENNKKIR--QVKIVTLKSNLVSNFRKEF | DD | ELYKVREINDY | 981 |
| WP_024783594 | 911 | KAGFIKRQLVETRQITKHVARILDERFNTETDENNKKIR--QVKIVTLKSNLVSNFRKEF | DD | ELYKVREINDY | 981 |
| WP_024784288 | 913 | KAGFIKRQLVETRQITKHVARMLDERFNKEFDDNNKRIR--RVKIVTLKSSFVSNFRKEF | DD | ELYKVREINDY | 983 |
| WP_024784666 | 911 | KAGFIKRQLVETRQITKHVARILDERFNTETDENNKKIR--QVKIVTLKSNLVSNFRKEF | DD | ELYKVREINDY | 981 |
| WP_024784894 | 911 | KAGFIKRQLVETRQITKHVARILDERFNTETDENNKKIR--QVKIVTLKSNLVSNFRKEF | DD | ELYKVREINDY | 981 |
| WP_024786433 | 913 | KAGFIKRQLVETRQITKHVARMLDERFNKEFDDNNKRIR--RVKIVTLKSNLVSSFRKEF | DD | ELYKVREINDY | 983 |
| WP_049473442 | 911 | KAGFIKRQLVETRQITKHVARILDERFNTETDENNKKIR--QVKIVTLKSNLVSNFRKEF | DD | ELYKVREINDY | 981 |

-continued

| ID | | | | |
|---|---|---|---|---|
| WP_049474547 | 911 | DD | KAGFIKRQLVETRQITKHVARILDERFNTETDENNKKIR--QVKIVTLKSNLVSNFRKEF | ELYKVREINDY | 981 |
| EMC03581 | 904 | DD | KAGFIKRQLVETRQITKHVARILDERFHTETDENNKKIR--QVKIVTLKSNLVSNFRKEF | ELYKVREINDY | 974 |
| WP_000428612 | 916 | RD | KVGFIKRQLVETRQITKHVAQILDARYNTEVNEKDKKNR--TVKIITLKSNLVSNFRKEF | RLYKIREINDY | 986 |
| WP_000428613 | 914 | RD | KVGFIKRQLVETRQITKHVAQILDARFNKEVNEKDKKNR--TVKIITLKSNLVSNFRKEF | RLYKIREINDY | 984 |
| WP_049523028 | 909 | RD | KVGFIKRQLVETRQITKHVAQILDDRFNAEVNEKNQKLR--SVKIITLKSNLVSNFRKEF | GFYKIREVNDY | 979 |
| WP_003107102 | 880 | YD | KVGFIKRQLVETRQITKHVAQILANNRFNNNVDDSSKNKR--PVKIITLKSKMVSDFRKEF | GFYKLREINDY | 950 |
| WP_054279288 | 912 | SD | KANFIQRQLVETRQITKHVAQILDSRFNTERDEKDRPIR--EVKVITLKSKFVSDFRQDF | RLYKVREINDY | 982 |
| WP_049531101 | 914 | RD | KVGFIKRQLVETRQITKHVAQILDSRENTKVNEKNQKIR--TVKIITLKSNLVSNFRKEF | GLYKVREINDY | 984 |
| WP_049538452 | 914 | RD | KVGFIKRQLVETRQITKHVAQFLDARFNKEVTEKDKKNR--NVKIITLKSNLVSNFRKEF | RLYKVREINDY | 984 |
| WP_049549711 | 916 | LD | KVGFIKRQLVETRQITKHVARILDARENTEVSEKNQKIR--SVKIITLKSNLVSNFRKEF | GLYKLREVNNY | 986 |
| WP_007896501 | 917 | SD | KARPLRRQLVETRQITKHVAQLLDSRENSKSNQNKKLAR--NVKIITLKSKIVSDFRKDF | GLYKLREVNNY | 987 |
| EFR44625 | 869 | SD | KARPIQRQLVETRQITKHVAQILDSRENSKSNQNKKLAR--NVKIITLKSKIVSDFRKDF | GLYKLREVNNY | 939 |
| WP_002897477 | 913 | RD | KVGFIRRQLVETQQITKNVAQILDARENTEVKEKNQKIR--TVKIITLKSNLVSNFRKEF | GLYKVREINNY | 983 |
| WP_002906454 | 913 | RD | KVGFIKRQLVETRQITKHVAQLLDTRENTEVNEENQKIR--TVKIITLKSNLVSNFRKEF | GLYKVREINDY | 983 |
| WP_009729476 | 914 | LD | KVGFIKRQLVETRQITKHVAQILDARFNKEVTEKDKKNR--TVKIITLKSNLVSNFRKEF | ELYKVREINDY | 984 |
| CQR24647 | 913 | ED | KAGFIKRQLVETRQITKHVARILDERFNRDFDKNDKIR--NVKIVTLKSNLVSNFRKEF | GFYKVREINNF | 983 |
| WP_000066813 | 918 | LD | KVGFIKRQLVETRQITKHVAQFLDARFNKEVTEKDKKNR--NVKIITLKSNLVSNFRKEF | GLYKVREINDY | 988 |
| WP_009754323 | 914 | RD | KVGFIKRQLVETRQITKHVARILDARENTEVSEKNQKIR--SVKIITLKSNLVSNFRKEF | KLYKVREINDY | 984 |
| WP_044674937 | 913 | ED | KARPIQRQLVETRQITKHVARILDTRENTKLDEAGNRIRdp-KVNIITLKSNLVSQFRKDY | QLYKVREINDY | 985 |
| WP_044676715 | 915 | ED | KARPIQRQLVETRQITKHVARILDTRENTKLDEAGNRIRdp-KVNIITLKSNLVSQFRKDY | QLYKVREINDY | 987 |
| WP_044680361 | 915 | ED | KARPIQRQLVETRQITKHVARILDTRENTKLDEAGNRIRdp-KVNIITLKSNLVSQFRKDY | QLYKVREINDY | 987 |
| WP_044681799 | 913 | ED | KARPIQRQLVETRQITKHVARILDTRENTKLDEAGNRIRdp-KVNIITLKSNLVSQFRKDY | QLYKVREINNY | 985 |
| WP_049533112 | 910 | ND | KAGFIARQLVETRQITKHVAQVLDARFNAKHDENKKVIR--DVKIITLKSNLVSNFRKEF | KFYKVREINNY | 980 |
| WP_029090905 | 891 | RD | KEGFIARQLVETRQITKHVTQLLQQEY--------K-dTTKVFAIKATLVSGLRRKF | EFIQNRNVNDY | 951 |
| WP_006506696 | 917 | ED | EERFINRQLVETRQITKNVTQIIEDHYST---------TKVAAIRANLSHEFRVKN | HIYKNRDINDY | 976 |
| AIT42264 | 911 | LD | KAGFIKRQLVETRQITKHVAQILLDSRMNTKYDENDKLIR--EVKVITLKSKLVSDERKDF | QFYKVREINNY | 981 |
| WP_034440723 | 915 | RD | RQQFINRQLVETRQITKHVANLLSHHLNEK----KEVG--EINIVLLKSALTSQFRKKE | DFYKVREINEY | 980 |
| AKQ21048 | 911 | LD | KAGFIKRQLVETRQITKHVAQILDSRMNTKYDENDKLIR--EVKVITLKSALVSDERKDF | QFYKVREINNY | 981 |
| WP_004636532 | 916 | AD | RAHFLNRQLVETRQITKHVANLLDSQYNTAEEQ----R--INIVLLKSMTSRFRKEF | KLYKVREINDY | 980 |
| WP_002364836 | 922 | ED | KAHFIQRQLVETRQITKNVAGILDQRYNANSKE-----K--KVQIITLKASLTSQFRSIF | GLYKVREVNDY | 987 |
| WP_016631044 | 873 | ED | KAHFIQRQLVETRQITKNVAGILDQRYNAKSKE-----K--KVQIITLKASLTSQFRSIF | GLYKVREVNDY | 938 |
| EM575795 | 655 | ED | KAHFIQRQLVETRQITKHVAAILDQYFN-QPEE-SK-NK--GIRIITLKSSLVSQFRKTF | GINKVREINNH | 722 |
| WP_002373311 | 922 | ED | KAHFIQRQLVETRQITKNVAGILDQYLNAKSKE-----K--KVQIITLKASLTSQFRSIF | GLYKVREVNDY | 987 |
| WP_002378009 | 922 | ED | KAHFIQRQLVETRQITKNVAGILDQRYNAKSKE-----K--KVQIITLKASLTSQFRSIF | GLYKVREVNDY | 987 |
| WP_002407324 | 922 | ED | KAHFIQRQLVETRQITKNVAGILNQRYNANSKE-----K--KVQIITLKASLTSQFRSIF | GLYKVREVNDY | 987 |
| WP_002413717 | 922 | ED | KAHFIQRQLVETRQITKNVAGILDQRYNAKSKE-----K--KVQIITLKASLTSQFRSIF | GLYKVREVNDY | 987 |
| WP_010775580 | 924 | ED | KAHFIQRQLVETRQITKNVAGILDQRYNAKSKE-----K--KVQIITLKASLVSQFRSIF | GLYKVREVNDY | 989 |
| WP_010818269 | 922 | ED | KAHFIQRQLVETRQITKNVAGILDQRYNAKSKE-----K--KVQIITLKASLTSQFRSIF | GLYKVREVNDY | 987 |
| WP_010824395 | 922 | ED | KAHFIQRQLVETRQITKHVAAILDQYFN-QPEE-SK-NK--GIRIITLKSSLVSQFRKTF | GLYKVREVNDY | 987 |
| WP_016622645 | 922 | ED | KAHFIQRQLVETRQITKNVAGILDQRYNAKSKE-----K--KVQIITLKASLTSQFRSIF | GLYKVREVNDY | 987 |
| WP_033624816 | 922 | ED | KAHFIQRQLVETRQITKNVAGILDQRYNAKSKE-----K--KVQIITLKASLTSQFRSIF | GLYKVREVNDY | 987 |
| WP_033625576 | 922 | ED | KAHFIQRQLVETRQITKNVAGILDQRYNAKSKE-----K--KVQIITLKASLTSQFRSIF | GLYKVREVNDY | 987 |
| WP_033789179 | 919 | ED | KARFIQRQLVETRQITKHVAGILHHREN-KAEDTNEPIR--KVRIITLKSALTSQFRNRF | GIYKVREINEY | 988 |
| WP_002310644 | 920 | ED | KARFIQRQLVETRQITKHVAGILHHREN-KAEDTNDPIR--KVRIITLKSALTSQFRNRF | GIYKVREINEY | 989 |
| WP_002312694 | 920 | ED | KARFIQRQLVETRQITKHVAGILHHREN-KAEDTNEPIR--KVRIITLKSALVSQFRNRF | GIYKVREINEY | 989 |
| WP_002314015 | 920 | ED | KARFIQRQLVETRQITKHVAGILHHREN-KAEDTNEPIR--KVRIITLKSALTSQFRNRF | GIYKVREINEY | 989 |
| WP_002320716 | 920 | ED | KARFIQRQLVETRQITKHVAGILHHREN-KAEDTNEPIR--KVRIITLKSALTSQFRNRF | GIYKVREINEY | 989 |
| WP_002330729 | 919 | ED | KARFIQRQLVETRQITKHVAGILHHRFN-KAEDTNEPIR--KVRIITLKSALTSQFRNRF | GIYKVREINEY | 988 |
| WP_002335161 | 920 | ED | KARFIQRQLVETRQITKHVAGILHHRFN-KAEDTNEPIR--KVRIITLKSALTSQFRNRF | GIYKVREINEY | 989 |
| WP_002345439 | 920 | ED | KARFIQRQLVETRQITKHVAGILHHRFN-KAEDTNEPIR--KVRIITLKSALVSQFRNRF | GIYKVREINEY | 989 |
| WP_034867970 | 911 | ED | KARFIQRQLVETRQITKHVANILHQSFN-QEEEGTD-CD--GVQIITLKATLTSQFRQTF | GLYKVREINPH | 979 |
| WP_047937432 | 920 | ED | KARFIQRQLVETRQITKHVAGILHHRFN-KAEDTNEPIR--KVRIITLKSALVSQFRNRF | GIYKVREINEY | 989 |
| WP_010720994 | 911 | ED | KARFIQRQLVETRQITKHVANILHQSFN-QEEEGTD-CD--GVQIITLKATLTSQFRQTF | GLYKVREINPH | 979 |

```
                              -continued

WP_010737004   911 ED KARFIQRQLVETRQITKHVANILHQSFN-QEEEGTD-CD--GVQIITLKATLTSQFRQTF GLYKVREINPH  979
WP_034700478   911 ED KARFIQRQLVETRQITKHVANILHQSFN-QEEEGTD-CD--GVQIITLKATLTSQFRQTF GLYKVREINPH  979
WP_007209003   912 SD KAGFLKRQLVETRQITKHVATILDSKFNE--DSNNRDVQ----IITLKSALVSEFRKTF NLYKVREINDL  977
WP_023519017   905 AD KARFIQRQLVETRQITKHVANILHQHFN-LPEEVSA-TE--KTSIITLKSTLTSQFRQMF DIYKVREINDY  973
WP_010770040   915 DD RAHFIKRQLVETRQITKHVARILDQRFNSQKDEEGKTIR-AVRVVTLKSSLTSQFRKNF AIHKVREINHH  985
WP_048604708   912 DD KAGFIHRQLVETRQITKNVARIIHQRFNSEKDEEGNLJR--KVRIITLKSALTSQFRKNY GIYKIREINDY  982
WP_010750235   914 DD KARFIQRQLVETRQITKHVAAILHQYFN-QTQELEK-EK--DIRIITLKSSLVSQFRQVF GIHKVREINHH  982
AII16583       950 LD KAGFIKRQLVETRQITKHVAQILDSRMNTKYDENDKLIR--EVKVITLKSKLVSDERKDF QFYKVREINNY 1020
WP_029073316   928 KD KERFINRQLVETRQITKHVAQIISNHYET---------------TKVVTVRADLSHAFRERY HIYKNRDINDF  987
WP_031589969   928 KD QERFINRQLVETRQITKHVAQIIDNHYEN---------------TKVVTVRADLSHQFRERY HIYKNRDINDF  987
KDA45870       903 KL KERFIERQLVETRQITKYVAQLLDQRLN-YDGNGVELD-eKIAIVTLKAQLASQFRSEF KLRKVRALNNL  972
WP_039099354   924 -D MKGFINERQLVETRQVIKLATNLLMEQYGED-------NIELITVKSGLTHQMRTEF DFPQNRNLHNH  990
AKP02966       926 KD KLGFIHRQLVQTSQMVKGVANILNSMYK---NQGTTCIQ------ARANLSTAFRKAL ELVKNRNINDF  999
WP_010991369   914 AD KARFIHRQLVETRQITKNVANILHQRFNYEKDDHGNTMK--QVRIVTLKSALVSQFRKQF QLYKVRDVNDY  984
WP_033838504   914 AD KARFIHRQLVETRQITKNVANILHQRFNYEKDDHGNTMK--QVRIVTLKSALVSQFRKQF QLYKVRDVNDY  984
EHN60060       917 AD KARFIHRQLVETRQITKNVANILHQRFNYEKDDHGNTMK--QVRIVTLKSALVSQFRKQF QLYKVRDVNDY  987
EFR89594       683 AD KARFIHRQLVETRQITKNVANILHQRFNYEKDDHGNTMK--QVRIVTLKSALVSQFRKQF QLYKVRGVNDY  753
WP_038409211   914 AD KANFIQRQLVETRQITKNVANILYQRFNCKQDENGNEVE--QVRIVTLKSTLVSQFRKQF QLYKVREVNDY  984
EFR95520       533 AD KARFIQRQLVETRQITKNVANILYQRFNCKQDENGNEVE--QVRIVTLKSTLVSQFRKQF QLYKVREVNDY  603
WP_003723650   914 AD KARFIHRQLVETRQITKNVANILYQRFNKETDNHGNTME--QVRIVTLKSALVSQFRKQF QLYKVREVNDY  984
WP_003727705   914 AD KARFIHRQLVETRQITKNVANILHQRFNKETDNHGNTME--QVRIVTLKSALVSQFRKQF QLYKVREVNDY  984
WP_003730785   914 AD KARFIHRQLVETRQITKNVANILHQRFNKETDNHGNTME--QVRIVTLKSALVSQFRKQF QLYKVREVNDY  984
WP_003733029   914 AD KARFIHRQLVETRQITKNVANILHQRFNKETDNHGNTME--TVRIVTLKSALVSQFRKQF QFYKVREVNDY  984
WP_003739838   914 AD KATFIHRQLVETRQITKNVANILHQRFNYETDNHGNTME--QVRIVTLKSALVSQFRKQF QLYKVREVNDY  984
WP_014601172   914 AD KARFIHRQLVETRQITKNVANILHQRFNNETDNHGNTME--PVRIVTLKSALVSQFRKQF QLYKVREVNDY  984
WP_023548323   914 AD KARFIHRQLVETRQITKNVANILHQRFNYETDNHGNEDTME--QVRIVTLKSALVSQFRKQF QLYKVREVNDY  984
WP_031669209   914 AD KARFIHRQLVETRQITKNVANILHQRFNYTDGNKDTME--TVRIVTLKSALVSQFRKQF QFYKVREVNDY  984
WP_033920898   914 AD KARFIHRQLVETRQITKNVANILHQRFNNETDNHGNTME--PVRIVTLKSALVSQFRKQF QFYKVREVNDY  984
AKI42028       917 AD KARFIHRQLVETRQITKNVANILHQRFNNETDNHGNEDTME--QVRIVTLKSALVSQFRKQF QLYKVREVNDY  987
AKI50529       917 AD KARFIHRQLVETRQITKNVANILHQRFNNETDNHGNGTME--QVRIVTLKSALVSQFRKQF QLYKVREVNDY  987
EFR83390       362 AD KARFIHRQLVETRQITKNVANILHQRFNNETDNHGNEDTME--QVRIVTLKAALVSQFRKQF QLYKVREVNDY  432
WP_046323366   914 AD KARFIHRQLVETRQITKNVANILHQRFNCKKDESGNVIE--QVRIVTLKAALVSQFRKQF QFYKVREVNDY  984
AKE81011       927 LD KAGFIKRQLVETRQITKHVAQILDSRMNTKYDENDKLIR--EVKVITLKSKLVSDERKDF QFYKVREINDF  997
CU082355       921 RD EERFINRQLVETRQITKNVTQIIEDHYST-------TKVAAIRANLSHEFRVKN HIYQNRDINDY  980
WP_033162887   923 KD KERFINRQLVETRQITKNVAVIINDHYTN-------TNIVTVRAELSHQFRERY KIYQNRDINDF  982
AGZ01981       944 LD KAGFIKRQLVETRQITKHVAQILDSRMNTKYDENDKLIR--EVKVITLKSKLVSDFRKDF QFYKVREINNY 1014
AKA60242       911 LD KAGFIKRQLVETRQITKHVAQILDSRMNTKYDENDKLIR--EVKVITLKSKLVSDFRKDF QFYKVREINNY  981
AKS40380       911 LD KAGFIKRQLVETRQITKHVAQILDSRMNTKYDENDKLIR--EVKVITLKSKLVSDFRKDF QFYKVREINNY  981
4UN5_B         915 LD KAGFIKRQLVETRQITKHVAQILDSRMNTKYDENDKLIR--EVKVITLKSKLVSDFRKDF QFYKVREINNY  985

WP_010922251   982 HHAHDAYLNAVVGTALIKKYPKL-ESEFVYGDYKVYDV S---EQEi-GK ATAKY--F-FYSNIM-NFFKTEIT 1051

WP_039695303   992 HHAHDAYLNAVVGTALIKKYPKL-ASEFVYGEYKKYDI S---SD------ KATAK--YfFYSNLM-NFFKTKVK 1058
WP_045635197   984 HHAHDAYLNAVVAKAILKKYPKL-EPEFVYGEYQKYDL SkdpKEV---EK ATEKY--F-FYSNLL-NFFKEEVH 1055
5AXW_A         703 HHAEDALI-------------IaNADFIFKEMKKLDK Nq-mFE----EK ETEQEyKEiFITPHQiKHIDFKD  771
WP_009880683   666 HHAHDAYLNAVVGTALIKKYPKL-ESEFVYGDYKVYDI S---EQEi-GK ATAKY--F-FYSNIM-NFFKTEIT  735
WP_010922251   982 HHAHDAYLNAVVGTALIKKYPKL-ESEFVYGDYKVYDV S---EQEi-GK ATAKY--F-FYSNIM-NFFKTEIT 1051
WP_011054416   982 HHAHDAYLNAVVGTALIKKYPKL-ESEFVYGDYKVYDV S---EQEi-GK ATAKY--F-FYSNIM-NFFKTEIT 1051
WP_011284745   982 HHAHDAYLNAVVGTALIKKYPKL-ESEFVYGDYKVYDV S---EQEi-GK ATAKY--F-FYSNIM-NFFKTEIT 1051
WP_011285506   982 HHAHDAYLNAVVGTALIKKYPKL-ESEFVYGDYKVYDV S---EQEi-GK ATAKY--F-FYSNIM-NFFKTEIT 1051
WP_011527619   982 HHAHDAYLNAVVGTALIKKYPKL-ESEFVYGDYKVYDV S---EQEi-GK ATAKY--F-FYSNIM-NFFKTEIT 1051
```

| | | | | |
|---|---|---|---|---|
| WP_012560673 | 982 | HHAHDAYLNAVVGTALIKKYPKL-ESEFVYGDYKVYDI | S---EQEi--GK | ATAKY--F-FYSNIM-NFFKTEIT | 1051 |
| WP_014407541 | 981 | HHAHDAYLNAVVGTALIKKYPKL-ESEFVYGDYKVYDV | S---EQEi--GK | ATAKY--F-FYSNIM-NFFKTEIT | 1050 |
| WP_020905136 | 982 | HHAHDAYLNAVVGTALIKKYPKL-ESEFVYGDYKVYDV | S---EQEi--GK | ATAKY--F-FYSNIM-NFFKTEIT | 1051 |
| WP_023080005 | 981 | HHAHDAYLNAVVGTALIKKYPKL-ESEFVYGDYKVYDV | S---EQEi--GK | ATAKY--F-FYSNIM-NFFKTEIT | 1050 |
| WP_023610282 | 981 | HHAHDAYLNAVVGTALIKKYPKL-ESEFVYGDYKVYDV | S---EQEi--GK | ATAKY--F-FYSNIM-NFFKTEIT | 1050 |
| WP_030125963 | 982 | HHAHDAYLNAVVGTALIKKYPKL-ESEFVYGDYKVYDV | S---EQEi--GK | ATAKY--F-FYSNIM-NFFKTEIT | 1051 |
| WP_030126706 | 982 | HHAHDAYLNAVVGTALIKKYPKL-ESEFVYGDYKVYDI | S---EQEi--GK | ATAKY--F-FYSNIM-NFFKTEIT | 1051 |
| WP_031488318 | 982 | HHAHDAYLNAVVGTALIKKYPKL-ESEFVYGDYKVYDV | S---EQEi--GK | ATAKY--F-FYSNIM-NFFKTEIT | 1051 |
| WP_032460140 | 982 | HHAHDAYLNAVVGTALIKKYPKL-ESEFVYGDYKVYDI | S---EQEi--GK | ATAKY--F-FYSNIM-NFFKTEIT | 1051 |
| WP_032461047 | 982 | HHAHDAYLNAVVGTALIKKYPKL-ESEFVYGDYKVYDV | S---EQEi--GK | ATAKY--F-FYSNIM-NFFKTEIT | 1051 |
| WP_032462016 | 982 | HHAHDAYLNAVVGTALIKKYPKL-ESEFVYGDYKVYDV | S---EQEi--GK | ATAKY--F-FYSNIM-NFFKTEIT | 1051 |
| WP_032462936 | 982 | HHAHDAYLNAVVGTALIKKYPKL-ESEFVYGDYKVYDV | S---EQEi--GK | ATAKY--F-FYSNIM-NFFKTEIT | 1051 |
| WP_032464890 | 982 | HHAHDAYLNAVVGTALIKKYPKL-ESEFVYGDYKVYDV | S---EQEi--GK | ATAKY--F-FYSNIM-NFFKTEIT | 1051 |
| WP_033888930 | 807 | HHAHDAYLNAVVGTALIKKYPKL-ESEFVYGDYKVYDV | S---EQEi--GK | ATAKY--F-FYSNIM-NFFKTEIT | 876 |
| WP_038431314 | 982 | HHAHDAYLNAVVGTALIKKYPKL-ESEFVYGDYKVYDV | S---EQEi--GK | ATAKY--F-FYSNIM-NFFKTEIT | 1051 |
| WP_038432938 | 981 | HHAHDAYLNAVVGTALIKKYPKL-ESEFVYGDYKVYDV | S---EQEi--GK | ATAKY--F-FYSNIM-NFFKTEIT | 1050 |
| WP_038434062 | 982 | HHAHDAYLNAVVGTALIKKYPKL-ESEFVYGDYKVYDV | S---EQEi--GK | ATAKY--F-FYSNIM-NFFKTEIT | 1051 |
| BAQ51233 | 893 | HHAHDAYLNAVVGTALIKKYPKL-ESEFVYGDYKVYDV | S---EQEi--GK | ATAKY--F-FYSNIM-NFFKTEIT | 962 |
| KGE60162 | 157 | HHAHDAYLNAVVGTALIKKYPKL-ESEFVYGDYKVYDV | S---EQEi--GK | ATAKY--F-FYSNIM-NFFKTEIT | 226 |
| KGE60856 | | ---------------------------------- | ---------- | ------------------------ | |
| WP_002989955 | 982 | HHAHDAYLNAVVGNALLKYPQL-EPEFVYGEYPKKN- | S---EQEi--GK | SATEK--F1FYSNIL-RFFKKE-- | 1041 |
| WP_003030002 | 981 | HHAHDAYLNAVVAKAILTKYPQL-ASEFVYGEYKKYDI | S---YR---sRK | KATAK--YfFYSNLM-NFFKRVIR | 1058 |
| WP_003065552 | 992 | HHAHDAYLNAVVAKAILTKYPQL-EPEFVYGDYPKYN- | S---SD---- | ATEKL--F-FYSNIM-NFFKRVVR | 1049 |
| WP_001040076 | 987 | HHAHDAYLNAVVAKAILTKYPQL-EPEFVYGDYPKYN- | L---SKI---VR | ATRKM--F-FYSNLM-NMFKRVVR | 1057 |
| WP_001040078 | 987 | HHAHDAYLNAVVAKAILTKYPQL-EPEFVYGDYPKYN- | S---YKT---RK | ATEKL--F-FYSNIM-NFFKTKVT | 1049 |
| WP_001040080 | 987 | HHAHDAYLNAVVAKAILTKYPQL-EPEFVYGLYRRKK- | S---YKT---RK | ATEKL--F-FYSNIM-NFFKTKVT | 1049 |
| WP_001040081 | 987 | HHAHDAYLNAVVAKAILTKYPQL-EPEFVYGDYPKYN- | S---YKT---RK | ATEKL--F-FYSNIM-NFFKTKVT | 1049 |
| WP_001040083 | 987 | HHAHDAYLNAVVAKAILTKYPQL-EPEFVYGDYPKYN- | S---YKT---RK | ATEKL--F-FYSNIM-NFFKTKVT | 1049 |
| WP_001040085 | 987 | HHAHDAYLNAVVAKAILTKYPQL-EPEFVYGDYPKYN- | S---YKT---RK | ATEKL--F-FYSNIM-NFFKTKVT | 1049 |
| WP_001040087 | 987 | HHAHDAYLNAVVAKAILTKYPQL-EPEFVYGDYPKYN- | S---YKT---RK | ATEKL--F-FYSNIM-NFFKTKVT | 1049 |
| WP_001040088 | 987 | HHAHDAYLNAVVAKAILTKYPQL-EPEFVYGDYPKYN- | S---YKT---RK | ATEKL--F-FYSNIM-NFFKTKVT | 1049 |
| WP_001040089 | 987 | HHAHDAYLNAVVAKAILTKYPQL-EPEFVYGDYPKYN- | S---YKT---RK | ATEKL--F-FYSNIM-NFFKTKVT | 1049 |
| WP_001040090 | 987 | HHAHDAYLNAVVAKAILTKYPQL-EPEFVYGDYPKYN- | S---YKT---RK | ATEKL--F-FYSNIM-NFFKTKVT | 1049 |
| WP_001040091 | 987 | HHAHDAYLNAVVAKAILTKYPQL-EPEFVYGDYPKYN- | S---YKT---RK | ATEKL--F-FYSNIM-NFFKTKVT | 1049 |
| WP_001040092 | 987 | HHAHDAYLNAVVAKAILTKYPQL-EPEFVYGDYPKYN- | S---YKT---RK | ATEKL--F-FYSNIM-NFFKTKVT | 1049 |
| WP_001040094 | 987 | HHAHDAYLNAVVAKAILTKYPQL-EPEFVYGDYPKYN- | S---YKT---RK | ATEKL--F-FYSNIM-NFFKTKVT | 1049 |
| WP_001040095 | 987 | HHAHDAYLNAVVAKAILTKYPQL-EPEFVYGDYPKYN- | S---YKT---RK | ATEKL--F-FYSNIM-NFFKTKVT | 1049 |
| WP_001040096 | 987 | HHAHDAYLNAVVAKAILTKYPQL-EPEFVYGDYPKYN- | S---YKT---RK | ATEKL--F-FYSNIM-NFFKTKVT | 1049 |
| WP_001040097 | 987 | HHAHDAYLNAVVAKAILTKYPQL-EREFVYGDYPKYN- | S---YKT---RK | ATEKL--F-FYSNIM-NFFKTKVT | 1049 |
| WP_001040098 | 987 | HHAHDAYLNAVVAKAILTKYPQL-EPEFVYGDYPKYN- | S---YKT---RK | ATEKL--F-FYSNIM-NFFKTKVT | 1049 |
| WP_001040099 | 987 | HHAHDAYLNAVVAKAILTKYPQL-EPEFVYGDYPKYN- | S---YKT---RK | ATEKL--F-FYSNIM-NFFKTKVT | 1049 |
| WP_001040100 | 987 | HHAHDAYLNAVVAKAILTKYPQL-EPEFVYGDYPKYN- | S---YKT---RK | ATEKL--F-FYSNIM-NFFKTKVT | 1049 |
| WP_001040104 | 987 | HHAHDAYLNAVVAKAILTKYPQL-EPEFVYGDYPKYN- | S---YKT---RK | ATEKL--F-FYSNIM-NFFKTKVT | 1049 |
| WP_001040105 | 987 | HHAHDAYLNAVVAKAILTKYPQL-EPEFVYGDYPKYN- | S---YKT---RK | ATEKL--F-FYSNIM-NFFKTKVT | 1049 |
| WP_001040106 | 987 | HHAHDAYLNAVVAKAILTKYPQL-EPEFVYGDYPKYN- | S---YKT---RK | ATEKL--F-FYSNIM-NFFKTKVT | 1049 |
| WP_001040107 | 987 | HHAHDAYLNAVVAKAILTKYPQL-EPEFVYGDYPKYN- | S---YKT---RK | ATEKL--F-FYSNIM-NFFKTKVT | 1049 |
| WP_001040108 | 987 | HHAHDAYLNAVVAKAILTKYPQL-EPEFVYGDYPKYN- | S---YKT---RK | ATEKL--F-FYSNIM-NFFKTKVT | 1049 |
| WP_001040109 | 987 | HHAHDAYLNAVVAKAILTKYPQL-EPEFVYGDYPKYN- | S---YKT---RK | ATEKL--F-FYSNIM-NFFKTKVT | 1049 |
| WP_001040110 | 987 | HHAHDAYLNAVVAKAILTKYPQL-EPEFVYGDYPKYN- | S---YKT---RK | ATEKL--F-FYSNIM-NFFKTKVT | 1049 |
| WP_015058523 | 987 | HHAHDAYLNAVVAKAILTKYPQL-EPEFVYGDYPKYN- | S---YKT---RK | ATEKL--F-FYSNIM-NFFKTKVT | 1049 |
| WP_017643650 | 987 | HHAHDAYLNAVVAKAILTKYPQL-EPEFVYGDYPKYN- | S---YKT---RK | ATEKL--F-FYSNIM-NFFKTKVT | 1049 |
| WP_017647151 | 987 | HHAHDAYLNAVVAKAILTKYPQL-EPEFVYGDYPKYN- | S---YKT---RK | ATEKL--F-FYSNIM-NFFKTKVT | 1049 |
| WP_017648376 | 987 | HHAHDAYLNAVVAKAILTKYPQL-EPEFVYGDYPKYN- | S---YKT---RK | ATEKL--F-FYSNIM-NFFKTKVT | 1049 |

| | | | | |
|---|---|---|---|---|
| WP_017649527 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_017771611 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_017771984 | 987 | HHAHDAYLNAVLNAVVAKAILTKYPQL-EPEFVYGDYPKYN- | S---YKT---RK | ATEKL-F-FYSNIM-NFFKTKVT | 1049 |
| CFQ25032 | 987 | HHAHDAYLNAVLNAVVAKAILTKYPQL-EPEFVYGDYPKYN- | S---YKT---RK | ATEKL-F-FYSNIM-NFFKTKVT | 1049 |
| CFV16040 | 987 | HHAHDAYLNAVLNAVVAKAILTKYPQL-EPEFVYGDYPKYN- | S---YKT---RK | ATEKL-F-FYSNIM-NFFKTKVT | 1049 |
| KLJ37842 | 987 | HHAHDAYLNAVLNAVVAKAILTKYPQL-EPEFVYGDYPKYN- | S---YKT---RK | ATEKL-F-FYSNIM-NFFKTKVT | 1049 |
| KLJ72361 | 987 | HHAHDAYLNAVLNAVVAKAILTKYPQL-EPEFVYGDYPKYN- | S---YKT---RK | ATEKL-F-FYSNIM-NFFKTKVT | 1049 |
| KLL20707 | 1001 | HHAHDAYLNAVLNAVVAKAILTKYPQL-EPEFVYGDYPKYN- | S---YKT---RK | ATEKL-F-FYSNIM-NFFKTKVT | 1063 |
| KLL42645 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_047207273 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_047209694 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_050198062 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_050201642 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_050204027 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_050881965 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_050886065 | 987 | HHAHDAYLNAVLNAVVAKAILTKYPQL-EPEFVYGDYPKYN- | S---YKT---RK | ATEKL-F-FYSNIM-NFFKTKVT | 1049 |
| AHN30376 | 987 | HHAHDAYLNAVLNAVVAKAILTKYPQL-EPEFVYGDYPKYN- | S---YKT---RK | ATEKL-F-FYSNIM-NFFKTKVT | 1049 |
| EA078426 | 987 | HHAHDAYLNAVLNAVVAKAILTKYPQL-EPEFVYGDYPKYN- | S---YKT---RK | ATEKL-F-FYSNIM-NFFKTKVT | 1049 |
| CCW42055 | 987 | HHAHDAYLNAVLNAVVAKAILTKYPQL-EPEFVYGDYPKYN- | S---YKT---RK | ATEKL-F-FYSNIM-NFFKTKVT | 1049 |
| WP_003041502 | 981 | HHAHDAYLNAVIGTALLKKYPKL-ASEFVYGEFKKYDV | S-DK---eIG | KATAK-YfFYSNLM-NFFKKEVK | 1050 |
| WP_037593752 | 982 | HHAHDAYLNAVVGNALLLKKYPQL-EPEFVYGEYPKYN- | S---YR---sRK | SATEK-F1FYSNIL-RPFFKKE-- | 1042 |
| WP_049516684 | 982 | HHAHDAYLNAVVGNALLLKKYPQL-EPEFVYGEYPKYN- | S---YR---sRK | SATEK-F1FYSNIL-RPFFKKE-- | 1042 |
| GAD46167 | 981 | HHAHDAYLNAVVGNALLLKKYPQL-EPEFVYGEYPKYN- | S---YR---sRK | SATEK-F1FYSNIL-RPFFKKE-- | 1041 |
| WP_018363470 | 990 | HHAHDAYLNAVVGTALIKKYPKL-APEFVYGEYKKYDV | S--SDDhseMG | KATAK-YfFYSNLM-NFFKRVIR | 1062 |
| WP_003043819 | 991 | HHAHDAYLNAVVGTALIKKYPKL-ESEFVYGDYKKYDV | S---EQEi-GK | ATAKR-F-FYSNIM-NFFKTEVK | 1060 |
| WP_006269658 | 981 | HHAHDAYLNAVVGNALLLKKYPQL-EPEFVYGEYPKYN- | S---YR---sRK | SATEK-F1FYSNIL-RPFFKKE-- | 1041 |
| WP_048800889 | 981 | HHAHDAYLNAVVGTALIKKYPKL-TSEFVYGEYKKYDV | S---DND---eIG | KATAK-YfFYSNLM-NFFKKE-- | 1051 |
| WP_012767106 | 981 | HHAHDAYLNAVVGTALLKKYTKL-ESEFVYGDYKKYDV | S---EQEi-GK | ATAKR-F-FYSNIM-NFFKTEIT | 1050 |
| WP_014612333 | 981 | HHAHDAYLNAVVGTALIKKYPKL-ESEFVYGDYKVYDV | S---EQEi-GK | ATAKR-F-FYSNIM-NFFKTEIT | 1050 |
| WP_015017095 | 981 | HHAHDAYLNAVVGTALIKKYPKL-ESEFVYGDYKVYDV | S---EQEi-GK | ATAKR-F-FYSNIM-NFFKTEIT | 1050 |
| WP_015057649 | 981 | HHAHDAYLNAVVGTALIKKYPKL-ESEFVYGDYKVYDV | S---EQEi-GK | ATAKR-F-FYSNIM-NFFKTEIT | 1050 |
| WP_048272215 | 981 | HHAHDAYLNAVVGTALIKKYPKL-ESEFVYGDYKVYDV | S---EQEi-GK | ATAKR-F-FYSNIM-NFFKTEIT | 1050 |
| WP_049519324 | 981 | HHAHDAYLNAVVAKAILGKYPQL-APEFVYGDYPKYN- | S---EQEi-GK | ATQKM-L-FYSNIL-KPFFKDQES | 1050 |
| WP_012515931 | 981 | HHAHDAYLNAVVAKAILGKYPQL-APEFVYGDYPKYN- | S---FKEi-QK | ATQKT-L-FYSNIL-KPFFKDQES | 1043 |
| WP_021320964 | 981 | HHAHDAYLNAVVAKAILGKYPQL-APEFVYGDYPKYN- | S---FKEi-QK | ATQKT-L-FYSNIL-KPFFKDQES | 1043 |
| WP_037581760 | 981 | HHAHDAYLNAVVAKAILGKYPQL-APEFVYGDYPKYN- | S---FKEr-QK | ATQKT-L-FYSNIL-KPFFKDQES | 1043 |
| WP_004232481 | 989 | HHAHDAYLNAVVGTALIKKYPKL-ASEFVYGEYKKYDV | S--SDNhseLG | KATAK-YfFYSNLM-NFFKTKVK | 1061 |
| WP_009854540 | 990 | HHAHDAYLNAVVGTALIKKYPKL-ASEFVYGEYKKYDI | S--SD----- | KATAK-YfFYSNLM-NFFKTKVK | 1056 |
| WP_012962174 | 990 | HHAHDAYLNAVVGTALIKKYPKL-APEFVYGEYKKYDI | S--GD----- | KATAK-YfFYSNLM-NFFKRVIR | 1056 |
| WP_039695303 | 992 | HHAHDAYLNAVVGTALLKKYPKL-ASEFVYGEYKKYDI | S--SDDyseMG | KATAK-YfFYSNLM-NFFKTKVK | 1058 |
| WP_014334983 | 989 | HHAHDAYLNAVVGTALLKKYPKL-ASEFVYGEYKKYDI | S--SDDyseMG | KATAK-YfFYSNLM-NFFKTKVK | 1061 |
| WP_003099269 | 982 | HHAHDAYLNAVVGTALLKKYPKL-TPEFVYGDYKHYDL | P---DSS1-GK | ATTRM-F-FYSNLM-NFFKKEIK | 1051 |
| AHY15608 | 982 | HHAQDAYLNAVVGTALLKKYPKL-EAEFVYGDYKHYDL | P---DSS1-GK | ATTRM-F-FYSNLM-NFFKKEIK | 1051 |
| AHY17476 | | | | | |
| ESR09100 | 982 | HHAQDAYLNAVIGKALLGVYPQL-EPEFVYGDYPHFH- | P---DSS1-GK | ATTRM-F-FYSNLM-NFFKKEIK | 1051 |
| AGM98575 | 982 | HHAHDAYLNAVIGKALLGVYPQL-EPEFVYGDYPHFH- | G---HK---eNK | ATAKK-F-FYSNIM-NFFKKD-- | 1041 |
| ALF27331 | 995 | HHAHDAYLNAVAQALLKVYPKF-EREIVGSVKESI | ----FS---RK | ATERM---rMYNNIL-KFISKD-- | 1055 |
| WP_018372492 | | | | | |

| | | | | | |
|---|---|---|---|---|---|
| WP_045618028 | 985 | HHAHDPYLNAVVAKAILKKYPKL-EPEFVYGDYQKYDL | TkdpKEV---EK | ATEKY--F-FYSNLL-NFFKEEVH | 1056 |
| WP_045635197 | 984 | HHAHDAYLNAVVAKAILKKYPKL-EPEFVYGEYQKYDL | SkdpKEV---EK | ATEKY--F-FYSNLL-NFFKEEVH | 1055 |
| WP_002263549 | 982 | HHAHDAYLNAVIGKALLGVYPQL-EPEFVYGDYPHFH- | G---HK---eNK | ATAKK--F-FYSNIM-NFFKKD-- | 1041 |
| WP_002263887 | 982 | HHAHDAYLNAVIGKALLGVYPQL-EPEFVYGDYPHFH- | G---HK---eNK | ATAKK--F-FYSNIM-NFFKKD-- | 1041 |
| WP_002264920 | 982 | HHAHDAYLNAVIGKALLGVYPQL-EPEFVYGDYPHFH- | G---HK---eNK | ATAKK--F-FYSNIM-NFFKKD-- | 1041 |
| WP_002269043 | 982 | HHAHDAYLNAVIGKALLGVYPQL-EPEFVYGDYPHFH- | G---HK---eNK | ATAKK--F-FYSNIM-NFFKKD-- | 1041 |
| WP_002269448 | 982 | HHAHDAYLNAVIGKALLGVYPQL-EPEFVYGDYPHFH- | G---HK---eNK | ATAKK--F-FYSNIM-NFFKKD-- | 1041 |
| WP_002271977 | 982 | HHAHDAYLNAVIGKALLGVYPQL-EPEFVYGDYPHFH- | G---HK---eNK | ATAKK--F-FYSNIM-NFFKKD-- | 1041 |
| WP_002272766 | 982 | HHAHDAYLNAVIGKALLGVYPQL-EPEFVYGDYPHFH- | G---HE---eNK | ATAKK--F-FYSNIM-NFFKKD-- | 1041 |
| WP_002273241 | 982 | HHAHDAYLNAVIGKALLGVYPQL-EPEFVYGDYPHFH- | G---HK---eNK | ATAKK--F-FYSNIM-NFFKKD-- | 1041 |
| WP_002275430 | 982 | HHAHDAYLNAVIGKALLGVYPQL-EPEFVYGDYPHFH- | G---HK---eNK | ATAKK--F-FYSNIM-NFFKKD-- | 1041 |
| WP_002276448 | 982 | HHAHDAYLNAVIGKALLGVYPQL-EPEFVYGDYPHFH- | G---HK---eNK | ATAKK--F-FYSNIM-NFFKKD-- | 1041 |
| WP_002277050 | 984 | HHAHDAYLNAVIGKALLGVYPKL-EPEFVYGEYPKYN- | S---YR---eRK | ATQKM--F-FYSNIM-NMFKSKVK | 1046 |
| WP_002277364 | 982 | HHAHDAYLNAVIGKALLGVYPQL-EPEFVYGDYPHFH- | G---HK---eNK | ATAKK--F-FYSNIM-NFFKKD-- | 1041 |
| WP_002279025 | 982 | HHAHDAYLNAVIGKALLGVYPQL-EPEFVYGDYPHFH- | G---HE---eNK | ATAKK--F-FYSNIM-NFFKKD-- | 1041 |
| WP_002279859 | 982 | HHAHDAYLNAVIGKALLGVYPQL-EPEFVYGDYPHFH- | G---HK---eNK | ATAKK--F-FYSNIM-NFFKKD-- | 1041 |
| WP_002280230 | 982 | HHAHDAYLNAVIGKALLGVYPQL-EPEFVYGDYPHFH- | G---HK---eNK | ATAKK--F-FYSNIM-NFFKKD-- | 1041 |
| WP_002281696 | 982 | HHAHDAYLNAVIGKALLGVYPQL-EPEFVYGDYPHFH- | G---HK---eNK | ATAKK--F-FYSNIM-NFFKKD-- | 1041 |
| WP_002282247 | 984 | HHAHDAYLNAVVKALLVKALLGVYPQL-EPEFVYGDYPHFH- | S---YR---eRK | ATQKM--F-FYSNIM-NMFKSKVK | 1046 |
| WP_002282906 | 982 | HHAHDAYLNAVIGKALLGVYPQL-EPEFVYGDYPHFH- | G---HK---eNK | ATAKK--F-FYSNIM-NFFKKD-- | 1041 |
| WP_002283846 | 982 | HHTHDAYLNAVIGKALLGVYPQL-EPEFVYGDYPHFH- | G---HK---eNK | ATAKK--F-FYSNIM-NFFKKD-- | 1041 |
| WP_002287255 | 982 | HHAHDAYLNAVIGKALLGVYPQL-EPEFVYGDYPHFH- | G---HK---eNK | ATAKK--F-FYSNIM-NFFKKD-- | 1041 |
| WP_002288990 | 982 | HHAHDAYLNAVIGKALLGVYPQL-EPEFVYGDYPHFH- | G---HK---eNK | ATAKK--F-FYSNIM-NFFKKD-- | 1041 |
| WP_002289641 | 982 | HHAHDAYLNAVIGKALLGVYPQL-EPEFVYGDYPHFH- | G---HK---eNK | ATAKK--F-FYSNIM-NFFKKD-- | 1041 |
| WP_002290427 | 982 | HHAHDAYLNAVIGKALLGVYPQL-EPEFVYGDYPHFH- | G---HK---eNK | ATAKK--F-FYSNIM-NFFKKD-- | 1041 |
| WP_002295753 | 982 | HHAHDAYLNAVIGKALLGVYPQL-EPEFVYGDYPHFH- | G---HK---eNK | ATAKK--F-FYSNIM-NFFKKD-- | 1041 |
| WP_002304487 | 996 | HHAHDAYLNAVIGKALLGVYPQL-EPEFVYGDYPHFH- | G---HK---eNK | ATAKK--F-FYSNIM-NFFKKG-- | 1055 |
| WP_002305844 | 982 | HHAHDAYLNAVIGKALLGVYPQL-EPEFVYGDYPHFH- | G---HK---eNK | ATAKK--F-FYSNIM-NFFKKD-- | 1041 |
| WP_002307203 | 982 | HHAHDAYLNAVIGKALLGVYPQL-EPEFVYGDYPHFH- | G---HK---eNK | ATAKK--F-FYSNIM-NFFKKD-- | 1041 |
| WP_002310390 | 982 | HHAHDAYLNAVIGKALLGVYPQL-EPEFVYGDYPHFH- | G---HK---eNK | ATAKK--F-FYSNIM-NFFKKD-- | 1041 |
| WP_002352408 | 982 | HHAHDAYLNAVIGKALLGVYPQL-EPEFVYGDYPHFH- | G---HK---eNK | ATAKK--F-FYSNIM-NFFKKD-- | 1041 |
| WP_012997688 | 984 | HHAHDAYLNAVVVKALLGVYPQL-EPEFVYGDYPHFH- | G---HK---eNK | ATAKK--F-FYSNIM-NFFKKD-- | 1041 |
| WP_014677909 | 982 | HHAHDAYLNAVIGKALLGVYPQL-EPEFVYGDYPHFH- | G---HK---eNK | ATAKK--F-FYSNIM-NFFKKD-- | 1041 |
| WP_019312892 | 982 | HHAHDAYLNAVIGKALLGVYPQL-EPEFVYGDYPHFH- | S---YR---eRK | ATQKM--F-FYSNIM-NMFKSKVK | 1046 |
| WP_019313659 | 982 | HHAHDAYLNAVIGKALLGVYPQL-EPEFVYGDYPHFH- | G---HK---eNK | ATAKK--F-FYSNIM-NFFKKD-- | 1041 |
| WP_019314093 | 984 | HHAHDAYLNAVVKALLVKALLGVYPKL-EPEFVYGDYPHFN- | S---YR---eRK | ATQKM--F-FYSNIM-NMFKSKVK | 1046 |
| WP_019315370 | 982 | HHAHDAYLNAVIGKALLGVYPQL-EPEFVYGDYPHFH- | G---HK---eNK | ATAKK--F-FYSNIM-NFFKKD-- | 1041 |
| WP_019803776 | 982 | HHAHDAYLNAVIGKALLGVYPQL-EPEFVYGDYPHFH- | G---HE---eNK | ATAKK--F-FYSNIM-NFFKKD-- | 1041 |
| WP_019805234 | 982 | HHAHDAYLNAVIGKALLGVYPQL-EPEFVYGDYPHFH- | G---HK---eNK | ATAKK--F-FYSNIM-NFFKKD-- | 1041 |
| WP_024783594 | 982 | HHAHDAYLNAVIGKALLGVYPQL-EPEFVYGDYPHFH- | G---HK---eNK | ATAKK--F-FYSNIM-NFFKKD-- | 1041 |
| WP_024784288 | 984 | HHAHDAYLNAVIGKALLGVYPKL-EPEFVYGEYLKYN- | S---YR---eRK | ATQKM--F-FYSNIM-NMFKSKVK | 1046 |
| WP_024784666 | 982 | HHAHDAYLNAVIGKALLGVYPQL-EPEFVYGDYPHFH- | G---HK---eNK | ATAKK--F-FYSNIM-NFFKKD-- | 1041 |
| WP_024784894 | 982 | HHAHDAYLNAVIGKALLGVYPQL-EPEFVYGDYPHFH- | G---HK---eNK | ATAKK--F-FYSNIM-NFFKKD-- | 1041 |
| WP_024786433 | 984 | HHAHDAYLNAVVKALLVKALLGVYPKL-EPEFVYGDYPKYN- | S---YR---eRK | ATQKM--F-FYSNIM-NMFKSKVK | 1046 |
| WP_049473442 | 982 | HHAHDAYLNAVIGKALLGVYPQL-EPEFVYGDYPHFH- | G---HK---eNK | ATAKK--F-FYSNIM-NFFKKD-- | 1041 |
| WP_049474547 | 975 | HHAHDAYLNAVIGKALLGVYPQL-EPEFVYGDYPHFH- | G---HK---eNK | ATAKK--F-FYSNIM-NFFKKD-- | 1034 |
| EMC03581 | 987 | HHAHDAYLNAVVAKAILKKYPKL-EPEFVYGDYQKYDL | SkdpKEI---EK | ATEKY--F-FYSNLL-NFFKEEVH | 1058 |
| WP_000428612 | 985 | HHAHDAYLNAVIGKALLKKYPKL-EPEFVYGDYQKYDL | SrnpKEV---EK | ATEKY--F-FYSNLL-NFFKEEVH | 1056 |
| WP_000428613 | 980 | HHAHDAYLNAVIGKALLKKYPKL-EPEFVYGDYPHFH- | TkdpKEI---EK | ATAKM--F-FYSNIM-NFFKDKVY | 1051 |
| WP_049523028 | 951 | HHAHDAYLNAVGTALLKKYPKL-EABFVYGDYKHYDL | S---DTSl-GK | ATAKM--F-FYSNLL-NFFKDKVY | 1020 |
| WP_003107102 | 983 | HHAHDAYLNAVGTALLKMYPKL-ASEFVYGDYQKYDL | S---GKAs-GH | ATAKY--F-FYSNLM-NFFKSEVK | 1052 |
| WP_054279288 | | | | | |

| | | | | | |
|---|---|---|---|---|---|
| WP_049531101 | 985 | HHAAHDAYLNAVVAKAILKKYPKL-EPEFVYGDYQKYDL | SrdpKEI---EK | ATEKY--F-FYSNLL-NFFKEEVH | 1056 |
| WP_049538452 | 985 | HHAAHDAYLNAVVAKAILKKYPKL-EPEFVYGDYQKYDL | SkdpKDI---EK | ATEKY--F-FYSNLL-NFFKEEVH | 1056 |
| WP_049549711 | 987 | HHAAHDAYLNAVVAKAILKKYPKL-EPEFVYGDYQKNDL | SkdpKDI---EK | ATEKY--F-FYSNLL-NFFKEEVH | 1058 |
| WP_007896501 | 988 | HHAAHDAYLNAVVGTALLKKYPKL-EABFVYGDYKHFDL | S---DPSl-GK | ATAKV--F-FYSNIM-NFFKEELS | 1057 |
| EFR44625 | 940 | HHAAHDAYLNAVVGTALLKKYPKL-EABFVYGDYKHFDL | S---DPSl-GK | ATAKV--F-FYSNIM-NFFKEELS | 1009 |
| WP_002897477 | 984 | HHAAHDAYLNAVVAKAILKKYPKL-EPEFVYGDYQKYDL | FkpsKEI---EK | ATEKY--F-FYSNLL-NFFKEEVL | 1055 |
| WP_002906454 | 984 | HHAAHDAYLNAVVAKAILKKYPKL-EPEFVYGDYQKYDL | SkasNTI---DK | ATEKY--F-FYSNLL-NFFKEKVR | 1055 |
| WP_009729476 | 985 | HHAAHDAYLNAVVAKAILKKYPKL-EPEFVYGDYQKYDL | SkdpKEI---EK | ATEKY--F-FYSNLL-NFFKEEVH | 1056 |
| CQR24647 | 984 | HHAAHDAYLNAVVAKALLIRYPKL-EPEFVYGEYPKYN- | S---YRE---RK | ATEKM--F-FYSNIM-NMFKTTIK | 1046 |
| WP_000066813 | 989 | HHAAHDAYLNAVLAKAILKKYPKL-EPEFVYGDYQKYDL | SrepKEV---EK | ATQKY--F-FYSNLL-NFFKEEVH | 1060 |
| WP_009754323 | 985 | HHAAHDAYLNAVVAKAILKKYPKL-EPEFVYGDYQKYDL | SkdpKEV---EK | ATEKY--F-FYSNLL-NFFKEEVH | 1056 |
| WP_044674937 | 986 | HHAAHDAYLNAVVATALLKKYPQL-EPEFVYGDYPKYN- | S---YKS---RK | ATAKV--L-FYSNIM-NFFRRVLV | 1048 |
| WP_044676715 | 988 | HHAAHDAYLNAVVATALLKKYPQL-APEFVYGDYPKYN- | S---YKS---RK | ATEKV--F-FYSNIM-NFFRRVLV | 1050 |
| WP_044680361 | 988 | HHAAHDAYLNAVVATALLKKYPQL-APEFVYGDYPKYN- | S---YKS---RK | ATEKV--L-FYSNIM-NFFRRVLV | 1050 |
| WP_044681799 | 986 | HHAAHDAYLNAVVAKAILKKYPKL-ASEFVYGEPKKYDV | S---DK---eIG | KATAK--YfFYSNLM-NFFRKKEVK | 1048 |
| WP_049533112 | 981 | HHAAHDAYLNAVIGTALLKKYPKI-EMEYLFKGYQHYLN | ---Ev-GK | AAKPKfF-IVENLS----------- | 1050 |
| WP_029090905 | 952 | HHAQDAFlVAFLGTNITSNYPKI-EMEYLFKGYQHYLN | ---NKNd-QK | ----g--FVINSM-NYPY-EV- | 1007 |
| WP_006506696 | 977 | HHAHDAYLIVALICGFMRDRYPNMhDSKAVYSEYMKMFR | S---EQEi-GK | ATQAK--Y-KMSNII-ERFSQDL- | 1038 |
| AIT42264 | 982 | HHAHDAYLNAVVGTALIKKYPKL-ESEFVYGDYKVYDV | G---EQEi-GK | ATAKY--F-FYSNIM-NFFKTEIT | 1051 |
| WP_034440723 | 981 | HHAHDAYLNAVIALKLLELLYPYM-AKDLIYGKYSYHRK | ---FKE---EK | ATARK--H-FYSNIT-KFFKEKKV | 1041 |
| AKQ21048 | 982 | HHAHDAYLNAVVGTALIKKYPKL-ESEFVYGDYKVYDV | ---FKE---NK | ATAKA--I-IYTNLL-RPFTED-- | 1051 |
| WP_004636532 | 981 | HHGHDAYLNAVVATTIMKVYPNL-KPQFVYGQYKKTSM | ---FKE---NK | ATAKA--I-IYTNLL-RPFTED-- | 1042 |
| WP_002364836 | 988 | HHGQDAYLNCVVATTLLKVYPNL-APEFVYGEYPKFQT | ---FKE---NK | ATAKA--I-IYTNLL-RPFTED-- | 1047 |
| WP_002407324 | 988 | HHGQDAYLNCVVATTLLKVYPNL-APEFVYGEYPKFQT | ---FKE---NK | ATAKA--I-IYTNLL-RPFTED-- | 1047 |
| WP_002413717 | 939 | HHGQDAYLNCVVATTLLKVYPNL-APEFVYGEYPKFQT | ---AT---eNK | ATAKA--E-FYSNIL-RPFEKE-- | 998 |
| EMS75795 | 723 | HHAAHDAYLNCVVAIALLKKYPNL-EPEFVYGNYTKFNL | ---FKE---NK | ATAKT--I-IYTNLM-RPFTED-- | 782 |
| WP_002373311 | 988 | HHGQDAYLNCVVATTLLKVYPNL-APEFVYGEYPKFQA | ---FKE---NK | ATAKT--I-IYTNLL-RPFTED-- | 1047 |
| WP_002378009 | 988 | HHGQDAYLNCVVATTLLKVYPNL-APEFVYGEYPKFQA | ---FKE---NK | ATAKA--I-IYTNLL-RPFTED-- | 1047 |
| WP_033789179 | 988 | HHGQDAYLNCVVATTLLKVYPNL-APEFVYGEYPKFQA | ---FKE---NK | ATAKA--I-IYTNLL-RPFTED-- | 1047 |
| WP_002310644 | 989 | HHGQDAYLNCVVATTLLKVYPQL-APEFVYGEYLKFNA | ---HK---aNK | ATAKA--I-IYTNLL-RPFTED-- | 1048 |
| WP_002312694 | 990 | HHGQDAYLNCVVATTLLKVYPNL-APEFVYGEYLKFNA | ---HK---aNK | ATVKK--E-FYSNIM-KFFESD-- | 1049 |
| WP_002314015 | 990 | HHGQDAYLNCVVATTLLKVYPNL-APEFVYGEYLKFNA | ---HK---aNK | ATVKK--E-FYSNIM-KFFESD-- | 1049 |
| WP_002320716 | 990 | HHGQDAYLNCVVATTLLKVYPNL-APEFVYGEYLKFNA | ---HK---aNK | ATVKK--E-FYSNIM-KFFESD-- | 1049 |
| WP_002330729 | 989 | HHGQDAYLNCVVATTLLKVYPNL-APEFVYGEYLKFNA | ---HK---aNK | ATVKK--E-FYSNIM-KFFESD-- | 1048 |
| WP_002335161 | 990 | HHGQDAYLNCVVATTLLKVYPNL-APEFVYGEYLKFNA | ---HK---aNK | ATVKK--E-FYSNIM-KFFESD-- | 1049 |
| WP_033624816 | 988 | HHGQDAYLNCVVATTLLKVYPNL-APEFVYGEYLKFNA | ---FKE---NK | AMAKA--I-IYTNLM-RPFTED-- | 1047 |
| WP_033625576 | 988 | HHGQDAYLNCVVATTLLKVYPNL-APEFVYGEYPKFQA | ---FKE---NK | ATAKA--I-IYTNLM-RPFTEV-- | 1047 |
| WP_002345439 | 990 | HHGQDAYLNGVVALALLKKYPNL-APEFVYGEYLKFNA | ---AR---eNK | ATAKK--E-FYSNIL-KPLESD-- | 1049 |
| WP_034867970 | 990 | HHGQDAYLNGVVALALLKKYPNL-APEFVYGEYLKFNA | ---AR---eNK | ATAKK--E-FYSNIL-KPLESD-- | 1049 |
| WP_047937432 | 990 | HHGHDAYLNGVIALALLKKYPNL-APEFVYGEYLKFNA | ---HK---aNK | ATVKK--E-FYSNIM-KFFESD-- | 1049 |
| WP_010720994 | 980 | HHAAHDAYLNGFIANVLLKKYPNL-APEFVYGKVKYSL | ---AR---aNK | ATAKK--E-FYSNIL-KFLESD-- | 1039 |
| WP_010737004 | 980 | HHAAHDAYLNGFIANVLLKKYPNL-APEFVYGKVKYSL | ---AR---aNK | ATAKK--E-FYSNIL-KFLESD-- | 1039 |
| WP_034700478 | 980 | HHAAHDAYLNGFIANVLLKKYPNL-APEFVYGKVKYSL | ---AR---aNK | ATAKK--E-FYSNIL-KFLESD-- | 1039 |
| WP_037209003 | 978 | HHAAHDAYLNAVVALSLLRVYPQL-KPEFVYGKNS- | ---IHDq--NK | ATIKK--qFYSNIT-RYFASK-- | 1037 |
| WP_023519017 | 974 | HHAAHDAYLNGVVAMTLLKKYPKL-APEFVYGSYIKGDI | ---NQ---INK | ATAKK--Q-LYTNIM-KFFAED-- | 1033 |
| WP_010770040 | 986 | HHGHDAYLNGVVANSLLRVYPQL-QPEFVYGEPHRFNA | ---YKA---NK | ATAKK--Q-FYSNLM-EFSKSD-- | 1045 |
| WP_048604708 | 983 | HHAAHDAYLNAVVALALLKKYPRL-APEFVYGSFAKFHL | ---VK---eNK | ATAKK--E-FYSNIL-KFFEKE-- | 1042 |
| WP_010750235 | 983 | HHAAHDAYLNAVVALALLKKYPRL-APEFVYGSFAKFHL | ---VK---eNK | ATAKK--E-FYSNIL-KFFEKE-- | 1042 |

| | | | | | |
|---|---|---|---|---|---|
| AII16583 | 1021 | HHAHDAYLNAVVGTALIKKYPKL-ESEFVYGDYKVYDV | S---EQEi--GK | ATAKY--F-FYSNIM-NFFKTEIT | 1090 |
| WP_029073316 | 988 | HHAHDAYIATILGTYIGHRFESL-DAKYIYGEYQKIFR | ----KDg--- | ---KDg---FILNSM-RNLYADK- | 1052 |
| WP_031589969 | 988 | HHAHDAYIATILGTYIGHRFESL-DAKYIYGEYKRIFR | ----NKNk--DK | ---NDg---FILNSM-RNIYADK- | 1052 |
| KDA45870 | 973 | HHAHDAYLNAVVANLIMAKYPEL-EPEFVYGKYRKTK- | ----QKNk--GK | ATAKN---tLYANVL-YPLKENEV | 1034 |
| WP_039099354 | 991 | HHAFDAYLTAFVGLYLLKRYPKL-KPYFVYGEYQKAS- | ----FKG1--DK | -RN--F----NFL-NGLKKD--- | 1043 |
| AKP02966 | 1000 | HHAQDAYLIASFLGTYRLRRFPTD-EMLLMNGEYNKFYG | ----QQ---DK | -SRKN-gF-IISpLV-------- | 1062 |
| WP_010991369 | 985 | HHAHDAYLNGVVANTLLKVYPQL-EPEFVYGDYHQFDW | ----KElysKK | ATAKK--Q-FYTNIM-LFFAQK- | 1044 |
| WP_033838504 | 988 | HHAHDAYLNGVVANTLLKVYPQL-EPEFVYGDYHQFDW | ----FKA--NK | ATAKK--Q-FYTNIM-LFFAQK- | 1044 |
| EHN60060 | 754 | HHAHDAYLNGVVANTLLKVYPQL-EPEFVYGDYHQFDW | ----FKA--NK | ATAKK--Q-FYTNIM-LFFAQK- | 813 |
| EFR89594 | 985 | HHAHDAYLNGVVANTLLKVYPQL-EPEFVYGDYHQFDW | ----FKA--NK | ATAKK--Q-FYTNIM-LFFAQK- | 1044 |
| WP_038409211 | 604 | HHAHDAYLNGVVANTLLKVYPQL-EPEFVYGDYHQFDW | ----FKA--NK | ATAKK--Q-FYTNIM-RFFAKE- | 663 |
| EFR95520 | 985 | HHAHDAYLNGVVANTLLKVYPQL-EPEFVYGEYHQFDW | ----FKA--NK | ATAKK--Q-FYTNIM-LFFAQK- | 1044 |
| WP_003723650 | 985 | HHAHDAYLNGVVANTLLKVYPQL-EPEFVYGEYHQFDW | ----FKA--NK | ATAKK--Q-FYTNIM-LFFAQK- | 1044 |
| WP_003727705 | 985 | HHAHDAYLNGVVANTLLKVYPQL-EPEFVYGEYHQFDW | ----FKA--NK | ATAKK--Q-FYTNIM-LFFAQK- | 1044 |
| WP_003730785 | 985 | HHAHDAYLNGVVANTLLKVYPQL-EPEFVYGEYHQFDW | ----FKA--NK | ATAKK--Q-FYTNIM-LFFAQK- | 1044 |
| WP_003733029 | 985 | HHAHDAYLNGVVANTLLKVYPQL-EPEFVYGEYHQFGW | ----FKA--NK | ATAKK--Q-FYTNIM-LFFAQK- | 1044 |
| WP_003739838 | 985 | HHAHDAYLNGVVANTLLKVYPQL-EPEFVYGEYHQFDW | ----FKA--NK | ATAKK--Q-FYTNIM-LFFAQK- | 1044 |
| WP_014601172 | 985 | HHAHDAYLNGVVANTLLKVYPQL-EPEFVYGEYHQFDW | ----FKA--NK | ATAKK--Q-FYTNIM-LFFGQK- | 1044 |
| WP_023548323 | 985 | HHAHDAYLNGVVANTLLKVYPQL-EPEFVYGEYHQFDW | ----FKA--NK | ATAKK--Q-FYTNIM-LFFAQK- | 1044 |
| WP_031665337 | 985 | HHAHDAYLNGVVANTLLKVYPQL-EPEFVYGEYHQFDW | ----FKA--NK | ATAKK--Q-FYTNIM-LFFAQK- | 1044 |
| WP_031669209 | 985 | HHAHDAYLNGVVANTLLKVYPQL-EPEFVYGEYHQFDW | ----FKA--NK | ATAKK--Q-FYTNIM-LFFAQK- | 1044 |
| WP_033920898 | 985 | HHAHDAYLNGVVANTLLKVYPQL-EPEFVYGEYHQFDW | ----FKA--NK | ATAKK--Q-FYTNIM-LFFAQK- | 1044 |
| AKI42028 | 988 | HHAHDAYLNGVVANTLLKVYPQL-EPEFVYGEYHQFDW | ----FKA--NK | ATAKK--Q-FYTNIM-LFFAQK- | 1047 |
| AKI50529 | 988 | HHAHDAYLNCVVANTLLKVYPQL-EPEFVYGEYHQFDW | ----FKA--NK | ATAKK--Q-FYTNIM-LFFAQK- | 1047 |
| EFR83390 | 433 | HHAHDAYLNAVVANTLLKVYPQL-EPEFVYGEYHQFDW | ----FKA--NK | ATAKY--F-FYSNIM-NFFKTEIT | 492 |
| WP_046323366 | 985 | HHAHDAYLNAVVGTALIKKYPKL-ESEFVYGDYKVYDV | S---EQEi--GK | ATAKY--F-FYSNIM-LFFAKK- | 1044 |
| AKE81011 | 998 | HHAHDAYIVALIGGFMRDRYPNMhDSKAVYSEYMKMFR | ----g---FVLNSM-NYPY-EV- | | 1067 |
| CU082355 | 981 | HHAHDAYIACIVGQFMHQNFEHL-DAKIIYGQYK--- | ----NKNd--QK | ----g---FVLNSM-NYPY-EV- | 1042 |
| WP_033162887 | 983 | HHAHDAYIACIVGQFMHQNFEHL-DAKIIYGQYK--- | ----NKNd--QK | ----NYg---FILNSM-NHLQSDI- | 1042 |
| AGZ01981 | 1015 | HHAHDAYLNAVVGTALIKKYPKL-ESEFVYGDYKVYDV | S---EQEi--GK | ATAKY--F-FYSNIM-NFFKTEIT | 1084 |
| AKA60242 | 982 | HHAHDAYLNAVVGTALIKKYPKL-ESEFVYGDYKVYDV | S---EQEi--GK | ATAKY--F-FYSNIM-NFFKTEIT | 1051 |
| AKS40380 | 982 | HHAHDAYLNAVVGTALIKKYPKL-ESEFVYGDYKVYDV | S---EQEi--GK | ATAKY--F-FYSNIM-NFFKTEIT | 1051 |
| 4UN5_B | 986 | HHAHDAYLNAVVGTALIKKYPKL-ESEFVYGDKVYDV | S---EQEi--GK | ATAKY--F-FYSNIM-NFFKTEIT | 1055 |
| WP_010922251 | 1052 | LAN-GEIRKRPLIE | TNGET-GE-IVWDKGRDFATVRKVLS-MPQVNIVKKTEVQT | GGFSK | ESIL-PKR- | 1114 |
| WP_039695303 | 1059 | YAD-GTVFERPIIE | T-NAD-GE-IAWNKQIDFEKVRKVLS-YPQVNIVKKVETQT | GGFSK | ESIL-PKG- | 1120 |
| WP_045635197 | 1056 | YAD-GTIVKRENIE | Y-SKDLGE-IAWNKEKDFAIIKKVLS-LPQVNIVKKVETQT | GGFSK | ESIL-PKG- | 1118 |
| 5AXW_A | 772 | YKYsHRVDKKPNRE | VNNLN-GL---YDKKDH--KLKKLINkSPEKLLMYHHDPQT | --YQK | KLIMeQYGd | 852 |
| WP_009880683 | 736 | LAN-GEIRKRPLIE | TNGET-GE-IVWDKGRDFATVRKVLS-MPQVNIVKKTEVQT | GGFSK | ESIL-PKR- | 798 |
| WP_010922251 | 1052 | LAN-GEIRKRPLIE | TNGET-GE-IVWDKGRDFATVRKVLS-MPQVNIVKKTEVQT | GGFSK | ESIL-PKR- | 1114 |
| WP_011054416 | 1052 | LAN-GEIRKRPLIE | TNGET-GE-IVWDKGRDFATVRKVLS-MPQVNIVKKTEVQT | GGFSK | ESIL-PKR- | 1114 |
| WP_011284745 | 1052 | LAN-GEIRKRPLIE | TNGET-GE-IVWDKGRDFATVRKVLS-MPQVNIVKKTEVQT | GGFSK | ESIL-PKR- | 1114 |
| WP_011285506 | 1052 | LAN-GEIRKRPLIE | TNGET-GE-IVWDKGRDFATVRKVLS-MPQVNIVKKTEVQT | GGFSK | ESIL-PKR- | 1114 |
| WP_011527619 | 1051 | LAN-GEIRKRPLIE | TNGET-GE-IVWDKGRDFATVRKVLS-MPQVNIVKKTEVQT | GGFSK | ESIL-PKR- | 1114 |
| WP_012560673 | 1051 | LAN-GEIRKRPLIE | TNGET-GE-IVWDKGRDFATVRKVLS-MPQVNIVKKTEVQT | GGFSK | ESIL-PKR- | 1113 |
| WP_014407541 | 1052 | LAN-GEIRKRPLIE | TNGET-GE-IVWDKGRDFATVRKVLS-MPQVNIVKKTEVQT | GGFSK | ESIL-PKR- | 1114 |
| WP_020905136 | 1051 | LAN-GEIRKRPLIE | TNGET-GE-IVWDKGRDFATVRKVLS-MPQVNIVKKTEVQT | GGFSK | ESIL-PKR- | 1113 |
| WP_023080005 | 1051 | LAN-GEIRKRPLIE | TNGET-GE-IVWDKGRDFATVRKVLS-MPQVNIVKKTEVQT | GGFSK | ESIL-PKR- | 1113 |
| WP_023610282 | 1052 | LAN-GEIRKRPLIE | TNGET-GE-IVWDKGRDFATVRKVLS-MPQVNIVKKTEVQT | GGFSK | ESIL-PKR- | 1114 |
| WP_030125963 | 1052 | LAN-GEIRKRPLIE | TNGET-GE-IVWDKGRDFATVRKVLS-MPQVNIVKKTEVQT | GGFSK | ESIL-PKR- | 1114 |
| WP_030126706 | 1052 | LAN-GEIRKRPLIE | TNGET-GE-IVWDKGRDFATVRKVLS-MPQVNIVKKTEVQT | GGFSK | ESIL-PKR- | 1114 |

| | | | | | | |
|---|---|---|---|---|---|---|
| WP_031488318 | 1052 | LAN-GEIRKRPLIE | TNGET-GE-IVWDKGRDFATVRKVLS-MPQVNIVKKTEVQT | GGFSK | ESIL-PKR- | 1114 |
| WP_032460140 | 1052 | LAN-GEIRKRPLIE | TNGET-GE-IVWDKGRDFATVRKVLS-MPQVNIVKKTEVQT | GGFSK | ESIL-PKR- | 1114 |
| WP_032461047 | 1052 | LAN-GEIRKRPLIE | TNGET-GE-IVWDKGRDFATVRKVLS-MPQVNIVKKTEVQT | GGFSK | ESIL-PKR- | 1114 |
| WP_032462016 | 1052 | LAN-GEIRKRPLIE | TNGET-GE-IVWDKGRDFATVRKVLS-MPQVNIVKKTEVQT | GGFSK | ESIL-PKR- | 1114 |
| WP_032462936 | 1052 | LAN-GEIRKRPLIE | TNGET-GE-IVWDKGRDFATVRKVLS-MPQVNIVKKTEVQT | GGFSK | ESIL-PKR- | 1114 |
| WP_032464890 | 1052 | LAN-GEIRKRPLIE | TNGET-GE-IVWDKGRDFATVRKVLS-MPQVNIVKKTEVQT | GGFSK | ESIL-PKR- | 1114 |
| WP_033888930 | 877 | LAN-GEIRKRPLIE | TNGET-GE-IVWDKGRDFATVRKVLS-MPQVNIVKKTEVQT | GGFSK | ESIL-PKR- | 939 |
| WP_038431314 | 1051 | LAN-GEIRKRPLIE | TNGET-GE-IVWDKGRDFATVRKVLS-MPQVNIVKKTEVQT | GGFSK | ESIL-PKR- | 1113 |
| WP_038432938 | 1052 | LAN-GEIRKRPLIE | TNGET-GE-IVWDKGRDFATVRKVLS-MPQVNIVKKTEVQT | GGFSK | ESIL-PKR- | 1114 |
| WP_038434062 | 963 | LAN-GEIRKRPLIE | TNGET-GE-IVWDKGRDFATVRKVLS-MPQVNIVKKTEVQT | GGFSK | ESIL-PKR- | 1025 |
| BAQ51233 | 227 | LAN-GEIRKRPLIE | TNGET-GE-IVWDKGRDFATVRKVLS-MPQVNIVKKTEVQT | GGFSK | ESIL-PKR- | 289 |
| KGE60162 | 1 | ------------IE | TNGET-GE-IVWDKGRDFATVRKVLS-MPQVNIVKKTEVQT | GGFSK | ESIL-PKR- | 52 |
| KGE60856 | 1052 | LAN-GEIRKRPLIE | TNGET-GE-IVWDKGRDFATVRKVLS-MPQVNIVKKTEVQT | GGFSK | ESIL-PKR- | 1114 |
| WP_002989955 | 1042 | ---------DIQ | T-NED-GE-IAWNKEKHIKILRKVLS-YPQVNIVKKTEBQT | GGFSK | ESIL-PKR- | 1093 |
| WP_003030002 | 1059 | YSN-GKVIVRPVVE | Y-SKD-TEqIAWDKKSNERTICKVLS-YPQVNIVKKETQT | GGFSK | ESIL-PKG- | 1121 |
| WP_003065552 | 1058 | LAD-GSIVVRPVIE | VNNDT-GE-IVWDKKKHFATVRKVLS-YPQVNIVKKTEIQT | GGFSK | ESIL-AHG- | 1120 |
| WP_001040076 | 1050 | LAD-GTVVVKDDIE | TGRYM-GK-TAWDKKKHFATVRKVLS-YPQVNIVKKTEIQT | GGFSK | ESIL-AHG- | 1112 |
| WP_001040078 | 1050 | LAD-GTVVVKDDIE | VNNDT-GE-IVWDKKKHFATVRKVLS-YPQVNIVKKTEIQT | GGFSK | ESIL-AHG- | 1112 |
| WP_001040080 | 1050 | LAD-ETVVVKDDIE | VNNDT-GE-IVWDKKKHFATVRKVLS-YPQNNIVKKTEIQT | GGFSK | ESIL-AHS- | 1112 |
| WP_001040081 | 1050 | LAD-GTVVVKDDIE | VNNET-GE-IAWDKKKHFATVRKVLS-YPQNNIVKKTEIQT | GGFSK | ESIL-AHS- | 1112 |
| WP_001040083 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040085 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040087 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040088 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040089 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040090 | 1050 | LAD-GTVVVKDDIE | VNNDT-GE-IVWDKKKHFATVRKVLS-YPQVNIVKKTEIQT | GGFSK | ESIL-AHG- | 1112 |
| WP_001040091 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040092 | 1050 | LAD-ETVVVKDDIE | VNNDT-GE-IAWDKKKHFATVRKVLS-YPQNNIVKKTEIQT | GGFSK | ESIL-AHS- | 1112 |
| WP_001040094 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040095 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040096 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040097 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040098 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040099 | 1050 | LAD-GTVVVKDDIE | VNNDT-GE-IAWDKKKHFATVRKVLS-YPQNNIVKKTEIQT | GGFSK | ESIL-AHG- | 1112 |
| WP_001040100 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040104 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040105 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040106 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040107 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040108 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040109 | 1050 | LAD-GTVVVKDDIE | VNNDT-GE-IVWDKKKHFATVRKVLS-YPQNNIVKKTEIQT | GGFSK | ESIL-AHG- | 1112 |
| WP_001040110 | 1050 | LAD-GTVVVKDDIE | VNNDT-GE-IVWDKKKHFATVRKVLS-YPQNNIVKKTEIQT | GGFSK | ESIL-AHG- | 1112 |
| WP_015058523 | 1050 | LAD-ETVVVKDDIE | VNNDT-GE-IAWDKKKHFATVRKVLS-YPQNNIVKKTEVQT | GGFSK | ESIL-AHS- | 1112 |
| WP_017643650 | 1050 | LAD-GTVVVKDDIE | VNNDT-GE-IVWDKKKHFATVRKVLS-YPQNNIVKKTEIQT | GGFSK | ESIL-AHG- | 1112 |
| WP_017647151 | 1050 | LAD-GTVVVKDDIE | VNNDT-GE-IVWDKKKHFATVRKVLS-YPQNNIVKKTEIQT | GGFSK | ESIL-AHG- | 1112 |
| WP_017648376 | 1050 | LAD-GTVVVKDDIE | VNNDT-GE-IVWDKKKHFATVRKVLS-YPQNNIVKKTEIQT | GGFSK | ESIL-AHG- | 1112 |
| WP_017649527 | 1050 | LAD-GTVVVKDDIE | VNNDT-GE-IVWDKKKHFATVRKVLS-YPQNNIVKKTEIQT | GGFSK | ESIL-AHG- | 1112 |
| WP_017771611 | 1050 | LAD-GTVVVKDDIE | VNNDT-GE-IVWDKKKHFATVRKVLS-YPQNNIVKKTEIQT | GGFSK | ESIL-AHG- | 1112 |
| WP_017771984 | 1050 | LAD-GTVVVKDDIE | VNNDT-GE-IVWDKKKHFATVRKVLS-YPQNNIVKKTEIQT | GGFSK | ESIL-AHG- | 1112 |
| CFQ25032 | 1050 | LAD-GTVVVKDDIE | VNNDT-GE-IVWDKKKHFATVRKVLS-YPQNNIVKKTEIQT | GGFSK | ESIL-AHG- | 1112 |
| CFV16040 | 1050 | LAD-GTVVVKDDIE | VNNDT-GE-IVWDKKKHFATVRKVLS-YPQNNIVKKTEIQT | GGFSK | ESIL-AHG- | 1112 |
| KLJ37842 | 1050 | LAD-GTVVVKDDIE | VNNDT-GE-IVWDKKKHFATVRKVLS-YPQNNIVKKTEIQT | GGFSK | ESIL-AHG- | 1112 |
| KLJ72361 | 1050 | LAD-GTVVVKDDIE | VNNDT-GE-IVWDKKKHFATVRKVLS-YPQNNIVKKTEIQT | GGFSK | ESIL-AHG- | 1112 |

| ID | | | | | |
|---|---|---|---|---|---|
| KLL20707 | 1064 | LAD-GTVVVKDDIE | VNNDT-GE-IVWDKKKHFATVRKVLS-YPQNNIVKKTEIQT | GGFSK | ESIL-AHG- | 1126 |
| KLL42645 | 1050 | LAD-GTVVVKDDIE | VNNDT-GE-IVWDKKKHFATVRKVLS-YPQNNIVKKTEIQT | GGFSK | ESIL-AHG- | 1112 |
| WP_047207273 | 1050 | LAD-GTVVVKDDIE | VNNDT-GE-IVWDKKKHFATVRKVLS-YPQNNIVKKTEIQT | GGFSK | ESIL-AHG- | 1112 |
| WP_047209694 | 1050 | LAD-GTVVIKDDIE | VNNDT-GE-IVWDKKKHFATVRKVLS-YPQNNIVKKTEIQT | GGFSK | ESIL-AHG- | 1112 |
| WP_050198062 | 1050 | LAD-GTVVVKDDIE | VNNDT-GE-IVWDKKKHFATVRKVLS-YPQNNIVKKTEIQT | GGFSK | ESIL-AHG- | 1112 |
| WP_050201642 | 1050 | LAD-GTVVVKDDIE | VNNDT-GE-IVWDKKKHFATVRKVLS-YPQNNIVKKTEIQT | GGFSK | ESIL-AHG- | 1112 |
| WP_050204027 | 1050 | LAD-GTVVVKDDIE | VNNDT-GE-IVWDKKKHFATVRKVLS-YPQNNIVKKTEIQT | GGFSK | ESIL-AHG- | 1112 |
| WP_050881965 | 1050 | LAD-GTVVVKDDIE | VNNDT-GE-IAWDKKKHFATVRKVLS-YPQNNIVKKTEIQT | GGFSK | ESIL-AHG- | 1112 |
| WP_050886065 | 1050 | LAD-ETVVVKDDIE | VNNDT-GE-IVWDKKKHFATVRKVLS-YPQNNIVKKTEIQT | GGFSK | ESIL-AHS- | 1112 |
| AHN30376 | 1050 | LAD-GTVVVKDDIE | VNNDT-GE-IVWDKKKHFATVRKVLS-YPQNNIVKKTEIQT | GGFSK | ESIL-AHG- | 1112 |
| EA078426 | 1050 | LAD-GTVVVKDDIE | VNNDT-GE-IVWDKKKHFATVRKVLS-YPQNNIVKKTEIQT | GGFSK | ESIL-AHG- | 1112 |
| CCW42055 | 1050 | LAD-GTVVVKDDIE | VNNDT-GE-IVWDKKKHFATVRKVLS-YPQNNIVKKTEIQT | HGLDR | PSPK-PKP- | 1122 |
| WP_003041502 | 1051 | FAD-GTVVERPDIE | T-SED-GE-IAWNKQTDFKIVRKVLS-YPQVNIVKKTEEQT | GGFSK | ESIL-PKG- | 1094 |
| WP_037593752 | 1043 | ---------DIQ | T-NED-GE-IAWNKEKHIKILRKVLS-YPQVNIVKKTEEQT | GGFSK | ESIL-PKG- | 1094 |
| WP_049516684 | 1043 | ---------DIQ | T-NED-GE-IAWNKEKHIKILRKVLS-YPQVNIVKKTEEQT | GGFSK | ESIL-PKG- | 1094 |
| GAD46167 | 1042 | ---------DIQ | T-NED-GE-IAWNKEKHIKILRKVLS-YPQVNIVKKTEEQT | GGFSK | ESIL-PKG- | 1093 |
| WP_018363470 | 1063 | YSN-GKVIVRPVVE | Y-SKDtGE-IAWNKRTDFEKVRKVLS-YPQVNIVKKTEEQT | GGFSK | ESIL-PKG- | 1125 |
| WP_003043819 | 1061 | LAN-GEIRKRPLIE | TNGET-GE-VVWNKEKDFATVRKVLA-MPQVNIVKKTEVQT | GGFSK | ESIL-SKR- | 1123 |
| WP_066269658 | 1042 | ---------DIQ | T-NED-GE-IAWNKEKHIKILRKVLS-YPQVNIVKKTEEQT | GGFSK | ESIL-PKG- | 1093 |
| WP_048800089 | 1052 | FAD-GTVVERPDIE | T-SED-GE-IAWNKQTDFKIVRKVLS-YPQVNIVKKEKQT | GRFSK | ESIL-PKG- | 1113 |
| WP_012767106 | 1051 | LAN-GEIRKRPLIE | TNEET-GE-IVWDKGRDFATVRKVLS-MPQVNIVKKTEVQT | GALTN | ESIY-ARG- | 1113 |
| WP_014612333 | 1051 | LAN-GEIRKRPLIE | TNEET-GE-IVWDKGRDFATVRKVLS-MPQVNIVKKTEVQT | GALTN | ESIY-ARG- | 1113 |
| WP_015017095 | 1051 | LAN-GEIRKRPLIE | TNEET-GE-IVWNKGRDFATVRKVLS-MPQVNIVKKTEVQT | GALTN | ESIY-ARG- | 1113 |
| WP_015057649 | 1051 | LAN-GEIRKRPLIE | TNEET-GE-IVWDKGRDFATVRKVLS-MPQVNIVKKTEVQT | GALTN | ESIY-ARG- | 1113 |
| WP_048327215 | 1051 | LAN-GEIRKRPLIE | TNEET-GE-IVWDKGRDFATVRKVLS-MPQVNIVKKTEVQT | GALTN | ESIY-ARG- | 1113 |
| WP_049519324 | 1044 | L---------H | VNSD--GE-EIWNANKHLPIIKNVLS-IPQVNIVKKTEVQT | GGFYK | ESIL-SKG- | 1094 |
| WP_012515931 | 1044 | L---------H | VNSD--GE-EIWNANKHLPIIKNVLS-IPQVNIVKKTEVQT | GGFYK | ESIL-SKG- | 1094 |
| WP_021320964 | 1044 | L---------H | VNSD--GE-EIWNANKHLPIIKNVLS-IPQVNIVKKTEVQT | GGFSK | ESIL-SKG- | 1094 |
| WP_037581760 | 1062 | YAD-GRVFERPDIE | T-NAD-GE-IAWNKQRDFNIVRKVLS-YPQVNIVKKTEVQT | GGFSK | ESIL-PKG- | 1123 |
| WP_004232481 | 1057 | YAD-GTVVERPIIE | T-NAD-GE-IAWNKQIDFEKVRKVLS-YPQVNIVKKTEEQT | GGFSK | ESIL-PKG- | 1118 |
| WP_009854540 | 1059 | YSN-GKVVRPVIE | C-SKDtGE-IAWNKQIDFEKVRVLS-YPQVNIVKKTEVQT | GGFSK | ESIL-PKG- | 1119 |
| WP_012962174 | 1062 | YSN-GKVVRPVIE | T-NAD-GE-IAWNKQIDFEKVRKVLS-YPQVNIVKKTEVQT | GGFSK | ESIL-PKG- | 1120 |
| WP_039695303 | 1052 | YAD-GRVFERPDIE | T-NAD-GE-VVWNKQKDFDIVRKVLS-YPQVNIVKKVEAQT | GGFSK | ESIL-SKG- | 1123 |
| WP_014334983 | 1052 | LAD-DTIFTRPQIE | VNTET-GE-IVWDKVKDMQTIRKVMS-YPQVNIVMKTEVQT | GGFSK | ESIW-PKG- | 1114 |
| WP_003099269 | 1052 | LAD-DTIFTRPQIE | VNTET-GE-IVWDKVKDMQTIRKVMS-YPQVNIVMKTEVQT | GGFSK | ESIW-PKG- | 1114 |
| AHY15608 | 1052 | LAD-DTIFTRPQIE | VNTET-GE-IVWDKVKDMQTIRKVMS-YPQVNIVMKTEVQT | GGFSK | ESIW-PKG- | 1114 |
| AHY17476 | | | | | | |
| ESR09100 | 1052 | LAD-DTIFTRPQIE | T-NTET-GE-IIWKKDMQTIRSNIKKVLS-YPQVNIVKKTEEQT | GGFSK | ESIW-PKG- | 1114 |
| AGM98575 | 1042 | ---------DVR | T-DKN-GE-IIWKKDHISNIKKVLS-YPQVNIVKKREQS | GGFSK | ESIL-PKG- | 1093 |
| ALF27331 | 1056 | --K-------K | --DQtGE-IVWDKKEIENVKKVIY-SSPVNIVKKREQS | GALFK | QSNM-AVGy | 1108 |
| WP_018372492 | 1057 | YAD-GTIVKRENIE | Y-SKDtGE-IAWNKEKDFATIKKVLS-LPQVNIVKKTEEQT | GGLFD | NNIV-SKKr | 1124 |
| WP_045618028 | 1056 | YAD-GTIVKRENIE | Y-SKDtGE-IAWNKEKDFAIIKKVLS-LPQVNIVKKTEEQT | GGFSK | ESIL-PKG- | 1118 |
| WP_045635197 | 1042 | ---------DVR | T-DKN-GE-IIWKKDEHISNIKKVLS-YPQVNIVKKRREQT | GGFSK | ESIL-PKG- | 1093 |
| WP_002263549 | 1042 | ---------DVR | T-DKN-GE-IIWKKDEHISNIKKVLS-YPQVNIVKKVEEQT | GGFSK | ESIL-PKG- | 1093 |
| WP_002263887 | 1042 | ---------DVR | T-DKN-GE-IIWKKDEYISNIKKVLS-YPQVNIVKKVEEQT | GGFSK | ESIL-PKG- | 1093 |
| WP_002264920 | 1042 | ---------DVR | T-DKN-GE-IIWKKDEHISNIKKVLS-YPQVNIVKKVEEQT | GGFSK | ESIL-PKG- | 1093 |
| WP_002269043 | 1042 | ---------DVR | T-DKN-GE-IIWKKDEHISNIKKVLS-YPQVNIVKKVEEQT | GGFSK | ESIL-PKG- | 1093 |
| WP_002269448 | 1042 | ---------DVR | T-DKN-GE-IIWKKDEHISNIKKVLS-YPQVNIVKKVEEQT | GGFSK | ESIL-PKG- | 1093 |
| WP_002271977 | 1042 | ---------DVR | T-DKN-GE-IIWKKDEHISNIKKVLS-YPQVNIVKKVEEQT | GGFSK | ESIL-PKG- | 1093 |
| WP_002272766 | 1042 | ---------DVR | T-DKN-GE-IIWKKDEHISNIKKVLS-YPQVNIVKKVEEQT | GGFSK | ESIL-PKG- | 1093 |
| WP_002273241 | 1042 | ---------DVR | T-DKN-GE-IIWKKDEHISNIKKVLS-YPQVNIVKKVEEQT | GGFSK | ESIL-PKG- | 1093 |
| WP_002275430 | 1042 | ---------DVR | T-DKN-GE-IIWKKDEHISNIKKVLS-YPQVNIVKKVEEQT | GGFSK | ESIL-PKG- | 1093 |
| WP_002276448 | 1042 | ---------DVR | T-DRN-GE-IIWKKDEHISNIKKVLS-YPQVNIVKKVEEQT | GGFSK | ESIL-PKG- | 1093 |

| ID | | | | | | |
|---|---|---|---|---|---|---|
| WP_002277050 | 1047 | LAD-DQIVERPMIE | VNDET-GE-IAWDKTKHITTVKKVLS-YPQVNIVKKVEEQT | GGLFD | -----PKS- | 1111 |
| WP_002273364 | 1042 | ----------DVR | T-DKN-GE-IIWKKDEHISNIKKVLS-YPQVNIVKKVEEQT | GGFSK | ESIL-PKG- | 1093 |
| WP_002279025 | 1042 | ----------DVR | T-DKN-GE-IIWKKDEHISNIKKVLS-YPQVNIVKKVEEQT | GGFSK | ESIL-PKG- | 1093 |
| WP_002279859 | 1042 | ----------DVR | T-DKN-GE-IIWKKDEHISNIKKVLS-YPQVNIVKKVEEQT | GGFSK | ESIL-PKG- | 1093 |
| WP_002280230 | 1042 | ----------DVR | T-DKN-GE-IIWKKDEHISNIKKVLS-YPQVNIVKKVEEQT | GGFSK | ESIL-PKG- | 1093 |
| WP_002281696 | 1042 | ----------DVR | T-DKN-GE-IIWKKDEYISNIKKVLS-YPQVNIVKKVEEQT | GGFSK | ESIL-PKG- | 1093 |
| WP_002282247 | 1047 | LAD-DQIVERPMIE | VNDET-GE-IAWDKTKHITTVKKVLS-YPQVNIVKKVEEQT | GGLFD | -----PKS- | 1111 |
| WP_002282906 | 1042 | ----------DVR | I-DKN-GE-IIWKKDEHISNIKKVLS-YPQVNIVKKVEEQT | GGFSK | ESIL-PKG- | 1093 |
| WP_002283846 | 1042 | ----------DVR | T-DKN-GE-IIWKKDEHISNIKKVLS-YPQVNIVKKVEEQT | GGFSK | ESIL-PKG- | 1093 |
| WP_002287255 | 1042 | ----------DVR | T-DKN-GE-IIWKKDEHISNIKKVLS-YPQVNIVKKVEEQT | GGFSK | ESIL-PKG- | 1093 |
| WP_002288990 | 1042 | ----------DVR | T-DKN-GE-IIWKKDEHISNIKKVLS-YPQVNIVKKVEEQT | GGFSK | ESIL-PKG- | 1093 |
| WP_002289641 | 1042 | ----------DVR | T-DKN-GE-IIWKKDEHISNIKKVLS-YPQVNIVKKVEEQT | GGFFK | ESIL-PKG- | 1093 |
| WP_002290427 | 1042 | ----------DVR | T-DKN-GE-IIWKKDEYISNIKKVLS-YPQVNIVKKVEEQT | GGFSK | ESIL-PKG- | 1093 |
| WP_002295753 | 1042 | ----------DVR | T-DKN-GE-IIWKKDEHISNIKKVLS-YPQVNIVKKVEEQT | GGFSK | ESIL-PKG- | 1093 |
| WP_002296423 | 1042 | ----------DVR | T-DKN-GE-IIWKKDEYISNIKKVLS-YPQVNIVKKVEEQT | GGFSK | ESIL-PKG- | 1093 |
| WP_002304487 | 1056 | ----------DVR | T-DKN-GE-IIWKKDEHISNIKKVLS-YPQVNIVKKVEEQT | GGFSK | ESIL-PKG- | 1107 |
| WP_002305844 | 1042 | ----------DVR | T-DKN-GE-IIWKKDEHISNIKKVLS-YPQVNIVKKVEEQT | GGFSK | ESIL-PKG- | 1093 |
| WP_002307203 | 1042 | ----------DVR | T-DKN-GE-IIWKKDEHISNIKKVLS-YPQVNIVKKVEEQT | GGFSK | ESIL-PKG- | 1093 |
| WP_002310390 | 1042 | ----------DVR | T-DKN-GE-IIWKKDEYISNIKKVLS-YPQVNIVKKVEEQT | GGFFK | ESIL-PKG- | 1093 |
| WP_002352408 | 1042 | ----------DVR | T-DKN-GE-IIWKKDEHISNIKKVLS-YPQVNIVKKVEEQT | GGFSK | ESIL-PKG- | 1093 |
| WP_012997688 | 1042 | ----------DVR | T-DKN-GE-IIWKKDEYISNIKKVLS-YPQVNIVKKVEEQT | GGFSK | ESIL-PKG- | 1093 |
| WP_014677909 | 1042 | ----------DVR | T-DKN-GE-IIWKKDEHISNIKKVLS-YPQVNIVKKVEEQT | GGFSK | ESIL-PKG- | 1093 |
| WP_019312892 | 1042 | ----------DVR | T-DKN-GE-IIWKKDEYISNIKKVLS-YPQVNIVKKVEEQT | GGFSK | ESIL-PKG- | 1093 |
| WP_019313659 | 1042 | ----------DVR | T-DKN-GE-IIWKKDEHISNIKKVLS-YPQVNIVKKVEEQT | GGFSK | ESIL-PKG- | 1093 |
| WP_019314093 | 1042 | ----------DVR | T-DKN-GE-IIWKKDEHISNIKKVLS-YPQVNIVKKVEEQT | GGFSK | ESIL-PKG- | 1093 |
| WP_019315370 | 1042 | ----------DVR | T-DKN-GE-IIWKKDEHISNIKKVLS-YPQVNIVKKVEEQT | GGFSK | ESIL-PKG- | 1093 |
| WP_019803776 | 1042 | ----------DVR | T-DKN-GE-IIWKKDEYISNIKKVLS-YPQVNIVKKVEEQT | GGFSK | ESIL-PKG- | 1093 |
| WP_019805234 | 1042 | ----------DVR | T-DKN-GE-IIWKKDEHISNIKKVLS-YPQVNIVKKVEEQT | GGFSK | ESIL-PKG- | 1093 |
| WP_024783594 | 1042 | ----------DVR | T-DKN-GE-IIWKKDEHISNIKKVLS-YPQVNIVKKVEEQT | GGFSK | ESIL-PKG- | 1093 |
| WP_024784288 | 1047 | LAD-DQIVERPMIE | VNDET-GE-IAWDKTKHITTVKKVLS-YPQVNIVKKVEEQT | GGLFD | -----PKS- | 1111 |
| WP_024784666 | 1042 | ----------DVR | T-DKN-GE-IIWKKDEHISNIKKVLS-YPQVNIVKKVEEQT | GGFSK | ESIL-PKG- | 1093 |
| WP_024784894 | 1042 | ----------DVR | T-DKN-GE-IIWKKDEHISNIKKVLS-YPQVNIVKKVEEQT | GGFSK | ESIL-PKG- | 1093 |
| WP_024786433 | 1047 | LAD-DQIVERPMIE | VNDET-GE-IAWDKTKHITTVKKVLS-YPQVNIVKKVEEQT | GGLFD | -----PKS- | 1111 |
| WP_049473442 | 1042 | ----------DVR | T-DKN-GE-IIWKKDEHISNIKKVLS-YPQVNIVKKVEEQT | GGFSK | ESIL-PKG- | 1093 |
| WP_049473547 | 1042 | ----------DVR | T-DKN-GE-IIWKKDEHISNIKKVLS-YPQVNIVKKVEEQT | GGFSK | ESIL-PKG- | 1093 |
| EMC03581 | 1035 | ----------DVR | T-DKN-GE-IIWKKDEHISNIKKVLS-YPQVNIVKKVEEQT | GGFSK | ESIL-PKG- | 1086 |
| WP_000428612 | 1059 | YAD-GTIVKRENIE | Y-SKDtGE-IAWNKEKDFATIKKVLS-LPQVNIVKKREVQT | GGFSK | ESIL-PKG- | 1121 |
| WP_000428613 | 1052 | YAD-GTIVKRENIE | Y-SKDtGE-IAWNKEKDFATIKKVLS-YPQVNIVKKREVQT | GGFSK | ESIL-PKG- | 1114 |
| WP_049523028 | 1057 | YAD-GTIIQRGNVE | Y-SKDtGE-IAWNKKRDFAIVRKVLS-YPQVNIVKKREVQT | GGFSK | ESIL-PKG- | 1119 |
| WP_003107102 | 1021 | LAD-GTVITRPQIE | TNTET-GE-IVWDKVKDIKTIRKVLS-IPQINIVKKTEVQT | GGFSN | ESIL-SKR- | 1083 |
| WP_054279288 | 1053 | LAN-GNIKRSPIE | VNEET-GE-IVWDKFGTVRKVLS-APQVNIVKKTEIQT | GGFSK | ETIL-SKG- | 1115 |
| WP_049531101 | 1057 | YAD-GTIVKRENIE | Y-SKDtGE-IAWNKEIDFATIRKILS-LSQVNIVKKTEEQT | GGLFD | NNIV-SKKk | 1124 |
| WP_049538452 | 1056 | YAD-GTIVKRENIE | Y-SKDtGE-IAWNKEKDFATIKKILS-LPQVNIVKKTEEQT | GGLFD | NNIV-SKKk | 1124 |
| WP_049549711 | 1057 | YAD-GTIKKRENIE | Y-SNDtGE-IAWNKEKDFATIKKVLS-YPQVNIVKKTEEQT | GGLFD | ESVL-SKEk | 1126 |
| WP_007896501 | 1058 | LAD-GTLMKRPVIE | T-SKDtGE-IAWNKEKDFATIRKVLS-LPQVNIVKKREVQT | GAFSK | ESVL-SKG- | 1120 |
| EFR44625 | 1010 | LAD-GRVVEKPVIE | TNTET-GE-VVWDKVKDFKTIRKVLS-YPQVNIVKKTEIQS | GAFSK | ESVL-SKG- | 1072 |
| WP_002897477 | 1056 | YAD-GTIRKRENIE | ANEET-GE-IAWDKTKHFANVKKVLS-LPQVNIVKKTEIQT | GGFSK | ESIL-PKG- | 1118 |
| WP_002906454 | 1056 | YAD-GTIVKRENIE | Y-SKDtGE-IAWNKEKDFATVKKVLS-LPQVNIVKKTEVQT | GGFSK | ESIL-PKG- | 1123 |
| WP_009729476 | 1057 | YAD-GTIVKRENIE | Y-SKDtGE-IAWNKEKDFVTIKKVLS-LPQVNIVKKREVQT | GGFSK | ESIL-PKG- | 1119 |
| CQR24647 | 1047 | LAD-GRVVEKPVIE | ANEET-GE-IAWDKTKHFANVKKVLS-YPQVSIVKKVEEQT | GAFSK | ESVL-SKG- | 1109 |
| WP_000066813 | 1061 | YAD-GTIVKRENIE | Y-SKDtGE-IAWNKEKDFATVKKVLS-LPQVNIVKKTEVQT | GGFSK | ESIL-PKG- | 1123 |
| WP_009754323 | 1057 | YAD-GTIVKRENIE | Y-SKDtGE-IAWNKEKDFVTIKKVLS-YPQVNIVKKREVQT | GGFSK | ESIL-PKG- | 1119 |
| WP_044674937 | 1049 | YSKtGEVIRPVIE | VNKET-GE-IVWDKKSDFRTVRKVLS-YPQVNIVKKVEMQT | GGFSK | ESIL-QHG- | 1112 |

-continued

```
WP_044676715  1051  YSKtGEVRIRPVIE  VNKET-GE-IVWDKKSDFRTVRKVLS-YPQVNVVKKVEMQT  GGFSK  ESIL-QHG-  1114
WP_044680361  1051  YSKtGEVRIRPVIE  VNKET-GE-IVWDKKSDFRTVRKVLS-YPQVNVVKKVEMQT  GGFSK  ESIL-QHG-  1114
WP_044681799  1049  YSKtGEVRIRPVIE  VNKET-GE-IVWDKKSDFKTVRKVLS-YPQVNVVKKVEMQT  GGFSK  ESIL-QHG-  1112
WP_049533112  1051  FAD-GTVVERPDIE  T-SED-GE-IAWNKQTDFKIVRKVLS-YPQVNVVKKVEVQT  HGLDR  PSPK-PKP-  1122
WP_029090905  1008  -KQ--------Q   --NSTtGE-VKWNPEVD-DLINEIKKCFY-FKQCNIVRKVEEQS  GALFK  ETIY-PVEe  1061
WP_006506696  1039  -D--------    ------GK-LIWNP-DLINEIKKCFY-YKDCYCTTKLDQKS  GQLFN  -TVL-SNDa  1084
AIT42264      1052  LAN-GEIRKRPLIE TNGET-GE-IVWDKGRDFATVRKVLS-MPQVNIVKKTEVQT  GGFSK  ESIL-PKR-  1114
WP_034440723  1042  --------LA    --NPD-GE-IAWEKDKDLNTIRKVLS-SKQININIKKABEGK  GRLFK  ETIN-SRPs  1092
AKQ21048      1052  LAN-GEIRKRPLIE TNGET-GE-IVWDKGRDFATVRKVLS-MPQVNIVKKTEVQT  GGFSK  ESIL-PKR-  1114
WP_004636532  1043  -E--------P   RFTKD-GE-ILWDTERHLSTIKRVLS-WKQMNIVKKVEKQK  GQLWK  ETIY-QHG-  1092
WP_002364836  1048  -E--------P   RFTKD-GE-ILWSN-SYLKTIKKELN-YHQMNIVKKVEVQK  GGFSK  ESIK-PKG-  1098
WP_016631044  999   -E--------P   RFTKD-GE-ILWSN-SYLKTIKKELN-YHQMNIVKKVEVQK  GGFSK  ESIK-PKG-  1049
EMS75795      783   -E--------Y   SYDEN-GE-IFWDKARHIPQIKKVIS-SHQVNIVKKVEVQT  GGFYK  ETVN-PKG-  834
WP_002373311  1048  -E--------P   RFTKD-SE-ILWSN-SYLKTIKKELN-YHQMNIVKKVEVQK  GGFSK  ESIK-PKG-  1098
WP_002378009  1048  -E--------P   RFTKD-GE-ILWSN-SYLKTIKKELN-YHQMNIVKKVEVQK  GGFSK  ESIK-PKG-  1098
WP_002407324  1048  -E--------P   RFTKD-GE-ILWSN-SYLKTIKKELN-YHQMNIVKKVEVQK  GGFSK  ESIK-PKG-  1098
WP_002413717  1048  -E--------P   RFTKD-GE-ILWSN-SYLKTIKKELN-YHQMNIVKKVEVQK  GGFSK  ESIK-PKG-  1098
WP_010775580  1050  -E--------P   RFTKD-GE-ILWSN-SYLKTIKKELN-YHQMNIVKKVEVQK  GGFSK  ESIK-PKG-  1100
WP_010818269  1048  -E--------P   RFTKD-GE-ILWSN-SYLKTIKKELN-YHQMNIVKKVEVQK  GGFSK  ESIK-PKG-  1098
WP_010824395  1048  -E--------P   RFTKD-GE-ILWSN-SYLKTIKKELN-YHQMNIVKKVEVQK  GGFSK  ESIK-PKG-  1098
WP_016622645  1048  -E--------P   RFTKD-GE-ILWSN-SYLKTIKKELN-YHQMNIVKKVEVQK  GGFSK  ESIK-PKG-  1098
WP_033624816  1048  -E--------P   RFTKD-GE-ILWSN-SYLKTIKKELN-YHQMNIVKKVEVQK  GGFSK  ESIK-PKG-  1098
WP_033625576  1048  -E--------P   RFTKD-GE-ILWSN-SYLKTIKKELN-YHQMNIVKKVEVQK  GGFSK  ESIK-PKG-  1098
WP_033789179  1048  -E--------P   RFTKD-GE-ILWSN-SYLKTIKKELN-YHQMNIVKKVEVQK  GGFSK  ESIK-PKG-  1098
WP_002310644  1049  -T--------P   VCDEN-GE-IFWEKSKSIAQVKKVIN-HHHMNIVKKTEIQK  GGFSK  ETVE-PKK-  1100
WP_002312694  1050  -T--------P   VCDEN-GE-IFWEKSKSIAQVKKVIN-HHHMNIVKKTEIQK  GGFSK  ETVE-PKK-  1101
WP_002314015  1050  -T--------P   VCDEN-GE-IFWEKSKSIAQVKKVIN-HHHMNIVKKTEIQK  GGFSK  ETVE-PKK-  1101
WP_002320716  1050  -T--------P   VCDEN-GE-IFWEKSKSIAQVKKVIN-HHHMNIVKKTEIQK  GGFSK  ETVE-PKK-  1101
WP_002330729  1050  -T--------P   VCDEN-GE-IFWEKSKSIAQVKKVIN-HHHMNIVKKTEIQK  GGFSK  ETVE-PKK-  1101
WP_002335161  1050  -T--------P   VCDEN-GE-IFWEKSKSIAQVKKVIN-HHHMNIVKKTEIQK  GGFSK  ETVE-PKK-  1101
WP_002345439  1040  -E--------P   FCDEN-GE-IYWEKSHHLPRIKKVLS-SHQVNVVKKVEQQK  GGFSK  ETVN-SKE-  1091
WP_034867970  1040  -E--------P   FCDEN-GE-IYWEKSHHLPRIKKVLS-SHQVNVVKKVEQQK  GGFSK  ETVN-SKE-  1091
WP_047937432  1050  -E--------P   FCDEN-GE-IYWEKSHHLPRIKKVLS-SHQVNVVKKVEQQK  GGFYK  ETVE-PKK-  1101
WP_010720994  1040  -T--------P   FCDEN-GE-IYWEKSHHLPRIKKVLS-SHQVNVVKKVEQQK  GGFSK  ETVN-SKE-  1091
WP_010737004  1040  -E--------P   FCDEN-GE-IYWEKSHHLPRIKKVLS-SHQVNVVKKVEQQK  GGFYK  ETVN-SKE-  1091
WP_010737004  1040  -E--------P   FCDEN-GE-IYWEKSHHLPRIKKVLS-SHQVNVVKKVEQQK  GGFYK  ETVN-SKE-  1091
WP_010737004  1040  -E--------P   FCDEN-GE-IYWEKSHHLPRIKKVLS-SHQVNVVKKVEQQK  GGFYK  ETVN-SKE-  1091
WP_010737004  1040  -E--------P   FCDEN-GE-IYWEKSHHLPRIKKVLS-SHQVNVVKKVEQQK  GGFYK  ETVN-SKE-  1091
WP_010737004  1040  -D--------P   IINDD-GE-ILWNKQETIAQVIKTLG-MHQVNVVKKVEIQK  GGFSK  ESIQ-PKG-  1089
WP_023519017  1034  -E--------I   ICDEQ-GE-VIWNKKRDLSTIKKTIG-AHQVNIVKKVEKQK  GSFSK  ETIN-SKA-  1085
WP_010770040  1046  -A--------V   IIDEN-GE-ILWDK-KNIATVKKVMS-YPQMNIVKKPEIQT  GSFFN  ESIL-PKG-  1096
WP_048604708  1043  -K--------V   IIDEN-GE-ILWNQ-KKIVTVKKVMN-YRQMNIVKKVEIQK  GTFFN  ETVN-TKE-  1093
WP_010750235  1043  -E--------Q   FCDEN-GE-IFWDKRKHIQQIHKVIS-SHQVNIVKKTEIQK  GSFYK  ETVN-TKE-  1094
A1116583      1091  LAN-GEIRKRPLIE TNGET-GE-IVWDKGRDFATVRKVLS-MPQVNIVKKTEVQT  GGFSK  ESIL-PKR-  1153
WP_029073316  1053  -D--------    --------EWISRIKKCFY-YKDCFVKKLEENN  GSFFN  -TVR-PNDe  1099
WP_031589969  1053  -D--------    --T--GE-IVWDP-NYIDRIKKCFY-YKDCFVVKKLEENN  GTFFN  -TVL-PNDt  1099
KDA45870      1035  YPF--------   --------WDKARDLPTIKRYLY-RAQVNKVRKAERQT  GGFSD  EMLV-PKS-  1078
WP_039099354  1044  -E            LVDEN-TEaVIWNKESGLAYLNKIYQ-FKKILVTREVHENS  GALFN  QTLYaAKDd  1097
AKP02966      1063  -N--------GTTQ --DRNtGE-IIWNVG-FRDKILLKFN-YHQCNVTRKTEIKT  GQFYD  QTIYsPKNp  1118
WP_010991369  1045  -D--------R   IIDEN-GE-ILWDK-KYLDTVKKVMS-YRQMNIVKKVEIQK  GEFSK  ATIK-PKG-  1095
WP_033838504  1045  -D--------R   IIDEN-GE-ILWDK-KYLDTVKKVMS-YRQMNIVKKVEIQK  GEFSK  ATIK-PKG-  1095
EHN60060      814   -E--------I   IIDEN-GE-ILWDK-KYLDTVKKVMS-YRQMNIVKKVEIQK  GEFSK  ATIK-PKG-  864
EFR89594      1048  -D--------R   IIDKN-GE-ILWDN-RYLDTIKKVLS-YRQMNIVKKTEIQK  GEFSN  ATVN-PKG-  1098
WP_038409211  1045  -N--------Q   IIDKN-GE-ILWDN-RYLDTIKKVLS-YRQMNIVKKTEIQK  GEFSN  ATVN-PKG-  1095
EFR95520      664   -N--------Q   IIDKN-GE-ILWDN-RYLDTIKKVLS-YRQMNIVKKTEIQK  GEFSN  ATVN-PKG-  714
```

-continued

| ID | | | | | | | |
|---|---|---|---|---|---|---|---|
| WP_003723650 | 1045 | -E--------R | IIDEN-GE- | ILWDK-KYLETIKKVLD- | YRQMNIVKKTEIQK | GEFSK | ATIK-PKG- | 1095 |
| WP_003727705 | 1045 | -E--------R | IIDEN-GE- | ILWDK-KYLETIKKVLD- | YRQMNIVKKTEIQK | GEFSK | ATIK-PKG- | 1095 |
| WP_003730785 | 1045 | -E--------R | IIDEN-GE- | ILWDK-KYLETIKKVLG- | YRQINIVKKTEIQK | GEFSK | ATIK-PKG- | 1095 |
| WP_003733029 | 1045 | -D--------R | IIDEN-GE- | ILWDK-RYLETVKKVLG- | YRQMNIVKKTEIQK | GEFSN | VTPN-PKG- | 1095 |
| WP_003739838 | 1045 | -E--------R | IIDEN-GE- | ILWDK-KYLETIKKVLD- | YRQMNIVKKTEIQK | GEFSK | ATIK-PKG- | 1095 |
| WP_014601172 | 1045 | -E--------R | IIDEN-GE- | ILWDK-KYLETIKKVLD- | YRQMNIVKKTEIQK | GEFSN | ATIK-PKG- | 1095 |
| WP_023548323 | 1045 | -E--------R | IIDEN-GE- | ILWDK-KYLETIKKVLD- | YRQMNIVKKTEIQK | GEFSN | QNPK-PRG- | 1095 |
| WP_031665337 | 1045 | -E--------R | IIDEN-GE- | ILWDK-KYLETIKKVLD- | YRQMNIVKKTEIQK | GEFSK | ATIK-PKG- | 1095 |
| WP_031669209 | 1045 | -D--------R | IIDEN-GE- | ILWDK-KYLETKKVLG- | YRQMNIVKKTEIQK | GEFSN | VTPN-PKG- | 1095 |
| WP_033920898 | 1048 | -E--------R | IIDEN-GE- | ILWDK-KYLETIKKVLN- | YRQMNIVKKTEIQK | GEFSN | QNPK-PRG- | 1098 |
| AKI42028 | 1048 | -E--------R | IIDEN-GE- | ILWDK-KYLETIKKVLN- | YRQMNIVKKTEIQK | GEFSN | QNPK-PRG- | 1098 |
| AKI50529 | 493 | | | | | | | 543 |
| EFR83390 | 1045 | -D--------R | IIDEN-GE- | ILWDK-KYLDTIKKVLN- | YRQMNIVKKTEIQK | GEFSN | ATIK-PKG- | 1095 |
| WP_046323366 | 1068 | LAN-GEIRKRPLIE | TNGET-GE- | IVWDKGRDFATVRKVLS- | MPQVNIVKKTEVQT | GGFSK | ESIL-PKR- | 1130 |
| AKE81011 | 1045 | -D--------R | | GK-LIWNP-DLINEIKKCFY- | YKDCYCTTKLDQKS | GQMFN | -TVL-PNDa | 1088 |
| CUO82355 | 1043 | -D--------R | | | | | | 1088 |
| WP_033162887 | 1085 | LAN-GEIRKRPLIE | ---T-GE- | VMWDP-AKIGKIKSCFY- | YKDVYTKKLEQNS | GTLFN | -TVL-PNDa | 1089 |
| AGZ01981 | 1085 | LAN-GEIRKRPLIE | TNGET-GE- | IVWDKGRDFATVRKVLS- | MPQVNIVKKTEVQT | GGFSK | ESIL-PKR- | 1147 |
| AKA60242 | 1052 | LAN-GEIRKRPLIE | TNGET-GE- | IVWDKGRDFATVRKVLS- | MPQVNIVKKTEVQT | GGFSK | ESIL-PKR- | 1114 |
| AKS40380 | 1052 | LAN-GEIRKRPLIE | TNGET-GE- | IVWDKGRDFATVRKVLS- | MPQVNIVKKTEVQT | GGFSK | ESIL-PKR- | 1114 |
| 4UN5_B | 1056 | | TNGET-GE- | IVWDKGRDFATVRKVLS- | MPQVNIVKKTEVQT | GGFSK | ESIL-PKR- | 1118 |
| WP_010922251 | 1115 | -NSD | KLIA---RKKDW-DPKKYGGFDSPTVAYSV-LVVAK--VE--KGKSKKLKSVKELLGITIME | | | | RSSFEK | 1176 |
| WP_039695303 | 1121 | -DSD | KLIPRKTkKV-DTKKYGGFDSPTVAYSV-FVVAD--VE--KGKAKKLTVKELVGISIME | | | | RSFFEE | 1185 |
| WP_045635197 | 1119 | -NSD | KLIPRKT-KDILL-DTTKYGGFDSPVIAYSI-LLIAD--IE--KGKAKKLTVKTLVGITIME | | | | KAAFEE | 1183 |
| 5AXW_A | 853 | -BKN | -LYKYYBeTGNYL--TKYSKKDNGPVIKKI---------KYYGNKLNAHLDITDDYPNS | | | | -VKLSL | 912 |
| WP_009880683 | 799 | -NSD | KLIA---RKKDW-DPKKYGGFDSPTVAYSV-LVVAK--VE--KGKSKKLKSVKELVGITIME | | | | RSSFEK | 860 |
| WP_010922251 | 1115 | -NSD | KLIA---RKKDW-DPKKYGGFDSPTVAYSV-LVVAK--VE--KGKSKKLKSVKELVGITIME | | | | RSSFEK | 1176 |
| WP_011054416 | 1115 | -NSD | KLIA---RKKDW-DPKKYGGFDSPTVAYSV-LVVAK--VE--KGKSKKLKSVKELLGITIME | | | | RSSFEK | 1176 |
| WP_011284745 | 1115 | -NSD | KLIA---RKKDW-DPKKYGGFDSPTVAYSV-LVVAK--VE--KGKSKKLKSVKELLGITIME | | | | RSSFEK | 1176 |
| WP_011285506 | 1115 | -NSD | KLIA---RKKDW-DPKKYGGFDSPTVAYSV-LVVAK--VE--KGKSKKLKSVKELLGITIME | | | | RSSFEK | 1176 |
| WP_011527619 | 1115 | -NSD | KLIA---RKKDW-DPKKYGGFDSPTVAYSV-LVVAK--VE--KGKSKKLKSVKELLGITIME | | | | RSSFEK | 1176 |
| WP_012560673 | 1114 | -NSD | KLIA---RKKDW-DPKKYGGFDSPTVAYSV-LVVAK--VE--KGKSKKLKSVKELVGITIME | | | | RSSFEK | 1175 |
| WP_014407541 | 1115 | -NSD | KLIA---RKKDW-DPKKYGGFDSPTVAYSV-LVVAK--VE--KGKSKKLKSVKELLGLTIME | | | | RSSFEK | 1176 |
| WP_020905136 | 1114 | -NSD | KLIA---RKKDW-DPKKYGGFDSPTVAYSV-LVVAK--VE--KGKSKKLKSVKELLGITIME | | | | RSSFEK | 1175 |
| WP_023080005 | 1115 | -NSD | KLIA---RKKDW-DPKKYGGFDSPTVAYSV-LVVAK--VE--KGKSKKLKSVKELLGITIME | | | | RSSFEK | 1175 |
| WP_023610282 | 1115 | -NSD | KLIA---RKKDW-DPKKYGGFDSPTVAYSV-LVVAK--VE--KGKSKKLKSVKELLGITIME | | | | RSSFEK | 1175 |
| WP_030125963 | 1115 | -NSD | KLIA---RKKDW-DPKKYGGFDSPTVAYSV-LVVAK--VE--KGKSKKLKSVKELLGITIME | | | | RSSFEK | 1176 |
| WP_030126706 | 1115 | -NSD | KLIA---RKKDW-DPKKYGGFDSPTVAYSV-LVVAK--VE--KGKSKKLKSVKELLGITIME | | | | RSSFEK | 1176 |
| WP_031488318 | 1114 | -NSD | KLIA---RKKDW-DPKKYGGFDSPTVAYSV-LVVAK--VE--KGKSKKLKSVKELLGITIME | | | | RSSFEK | 1176 |
| WP_032461047 | 1115 | -NSD | KLIA---RKKDW-DPKKYGGFDSPTVAYSV-LVVAK--VE--KGKSKKLKSVKELLGITIME | | | | RSSFEK | 1176 |
| WP_032462016 | 1115 | -NSD | KLIA---RKKDW-DPKKYGGFDSPTVAYSV-LVVAK--VE--KGKSKKLKSVKELLGITIME | | | | RSSFEK | 1176 |
| WP_032462936 | 1115 | -NSD | KLIA---RKKDW-DPKKYGGFDSPTVAYSV-LVVAK--VE--KGKSKKLKSVKELLGITIME | | | | RSSFEK | 1176 |
| WP_032464890 | 1115 | -NSD | KLIA---RKKDW-DPKKYGGFDSPTVAYSV-LVVAK--VE--KGKSKKLKSVKELVGITIME | | | | RSSFEK | 1175 |
| WP_033888930 | 940 | -NSD | KLIA---RKKDW-DPKKYGGFDSPTVAYSV-LVVAK--VE--KGKSKKLKSVKELLGITIME | | | | RSSFEK | 1001 |
| WP_038431314 | 1114 | -NSD | KLIA---RKKDW-DPKKYGGFDSPTVAYSV-LVVAK--VE--KGKSKKLKSVKELLGITIME | | | | RSSFEK | 1176 |
| WP_038432938 | 1115 | -NSD | KLIA---RKKDW-DPKKYGGFDSPTVAYSV-LVVAK--VE--KGKSKKLKSVKELLGITIME | | | | RSSFEK | 1175 |
| WP_038434062 | 1026 | -NSD | KLIA---RKKDW-DPKKYGGFDSPTVAYSV-LVVAK--VE--KGKSKKLKSVKELLGITIME | | | | RSSFEK | 1087 |
| BAQ51233 | 290 | -NSD | KLIA---RKKDW-DPKKYGGFDSPTVAYSV-LVVAK--VE--KGKSKKLKSVKELLGITIME | | | | RSSFEK | 351 |
| KGE60162 | 53 | -NSD | KLIA---RKKDW-DPKKYGGFDSPTVAYSV-LVVAK--VE--KGKSKKLKSVKELLGITIME | | | | RSSFEK | 114 |
| KGE60856 | 1115 | -NSD | KLIA---RKKDW-DPKKYGGFDSPTVAYSV-LVVAK--VE--KGKSKKLKSVKELLGITIME | | | | RSSFEK | 1176 |
| WP_002989955 | 1094 | -ESD | KLIPRKT-KNSYW-NPKKYGGFDSPVVAYSI-LVFAD--VE--KGKSKKLRKVQDMVGITIME | | | | KKRFEK | 1158 |
| WP_003030002 | | | | | | | | |

-continued

| | | | | | |
|---|---|---|---|---|---|
| WP_003065552 | 1122 | -DSD | KLIPRKTkKA-YW-DTKKYGGFDSPTVAYSV-FVVAD--VE--KGKAKKLKTVKELVGISIME | RSFFEE | 1186 |
| WP_001040076 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040078 | 1121 | -NSD | KLIPRKT-KDIYL-DPKKYGGFDSPIVAYSV-LVVAD--IK--KGKAQKLKTVTELLGITIME | RSKFEK | 1185 |
| WP_001040080 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040081 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040083 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040085 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040087 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040088 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040089 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040090 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040091 | 1113 | -NSD | KLIPRKT-KDIYL-DPKKYGGFDSPIVAYSV-LVVAD--IK--KGKAQKLKTVTELLGITIME | RERFEK | 1177 |
| WP_001040092 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040094 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040095 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040096 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040097 | 1113 | -NSD | KLIPRKT-KDIYL-DPKKYGGFDSPKVAYSV-LVVAD--IK--KGKAQKLKTVTELLGITIME | RSRFEK | 1177 |
| WP_001040098 | 1113 | -NSD | KLIPRKT-KDIYL-DPKKYGGFDSPIVAYSV-LVVAD--IK--KGKAQKLKTVKELIGITIME | RSRFEK | 1177 |
| WP_001040099 | 1113 | -NSD | KLIPRKT-KDIYL-DPKKYGGFDSPIVAYSV-LVLAD--IK--KGKAQKLKTVTELLGITIME | RSRFEK | 1177 |
| WP_001040100 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040104 | 1113 | -NSD | KLIPRKT-KDIYL-DPKKYGGFDSPIVAYSV-LVVAD--IK--KGKAQKLKTVTELLGITIME | RFRFEK | 1177 |
| WP_001040105 | 1113 | -NSD | KLIPRKT-KDIYL-DPKKYGGFDSPIVAYSV-LVVAD--IK--KGKAQKLKTVTELLGITIME | RFRFEK | 1177 |
| WP_001040106 | 1113 | -NSD | KLIPRKT-KDIYL-DPKKYGGFDSPIVAYSV-LVVAD--IK--KGKAQKLKTVTELLGITIME | RFRFEK | 1177 |
| WP_001040107 | 1113 | -NSD | KLIPRKT-KDIYL-DPKKYGGFDSPIVAYSV-LVVAD--IK--KGKAQKLKTVTELLGITIME | RERFEK | 1177 |
| WP_001040108 | 1113 | -NSD | KLIPRKT-KDIYL-DPKKYGGFDSPIVAYSV-LVLAD--IK--KGKAQKLKTVKELIGITIME | RERFEK | 1177 |
| WP_001040109 | 1113 | -NSD | KLIPRKT-KDIYL-DPKKYGGFDSPIVAYSV-LVVAD--IK--KGKAQKLKTVTELLGITIME | RSRFEK | 1177 |
| WP_001040110 | 1113 | -NSD | KLIPRKT-KDIYL-DPKKYGGFDSPIVAYSV-LVVAD--IK--KGKAQKLKTVTELLGITIME | RSRFEK | 1177 |
| WP_015058523 | 1113 | -NSD | KLIPRKT-KDIYL-DPKKYGGFDSPIVAYSV-LVVAD--IK--KGKAQKLKTVTELLGITIME | RFRFEK | 1177 |
| WP_017643650 | 1113 | -NSD | KLIPRKT-KDIYL-DPKKYGGFDSPIVAYSV-LVVAD--IK--KGKAQKLKTVTELLGITIME | RSRFEK | 1177 |
| WP_017647151 | 1113 | -NSD | KLIPRKT-KDIYL-DPKKYGGFDSPIVAYSV-LVAAD--IK--KGKAQKLKTVTELLGITIME | RSRFEK | 1177 |
| WP_017648376 | 1113 | -NSD | KLIPRKT-KDIYL-DPKKYGGFDSPIVAYSV-LVVAD--IK--KGKAQKLKTVTELLGITIME | RSRFEK | 1177 |
| WP_017649527 | 1113 | -NSD | KLIPRKT-KDIYL-DPKKYGGFDSPIVAYSV-LVVAD--IK--KGKAQKLKTVTELLGITIME | RFRFEK | 1177 |
| WP_017771611 | 1113 | -NSD | KLIPRKT-KDIYL-DPKKYGGFDSPIVAYSV-LVVAD--IK--KGKAQKLKTVTELLGITIME | RFRFEK | 1177 |
| WP_017771984 | 1113 | -NSD | KLIPRKT-KDIYL-DPKKYGGFDSPIVAYSV-LVVAD--IK--KGKAQKLKTVTELLGITIME | RSRFEK | 1177 |
| CFQ25032 | 1113 | -NSD | KLIPRKT-KDIYL-DPKKYGGFDSPIVAYSV-LVVAD--IK--KGKAQKLKTVTELLGITIME | RSRFEK | 1177 |
| CFV16040 | 1127 | -NSD | KLIPRKT-KDIYL-DPKKYGGFDSPIVAYSV-LVVAD--IK--KGKAQKLKTVTELLGITIME | RSRFEK | 1191 |
| KLJ37842 | 1113 | -NSD | KLIPRKT-KDIYL-DPKKYGGFDSPIVAYSV-LVVAD--IK--KGKAQKLKTVTELLGITIME | RSRFEK | 1177 |
| KLJ72361 | 1113 | -NSD | KLIPRKT-KDIYL-DPKKYGGFDSPIVAYSV-LVVAD--IK--KGKAQKLKTVTELLGITIME | RFRFEK | 1177 |
| KLL20707 | 1113 | -NSD | KLIPRKT-KDIYL-DPKKYGGFDSPIVAYSV-LVVAD--IK--KGKAQKLKTVTELLGITIME | RSRFEK | 1177 |
| KLL42645 | 1113 | -NSD | KLIPRKT-KDIYL-DPKKYGGFDSPIVAYSV-LVVAD--IK--KGKAQKLKTVTELLGITIME | RSRFEK | 1177 |
| WP_047207273 | 1113 | -NSD | KLIPRKT-KDIYL-DPKKYGGFDSPIVAYSV-LVVAD--IK--KGKAQKLKTVTELLGITIME | RSRFEK | 1177 |
| WP_047209694 | 1113 | -NSD | KLIPRKT-KDIYL-DPKKYGGFDSPIVAYSV-LVVAD--IK--KGKAQKLKTVTELLGITIME | RFRFEK | 1177 |
| WP_050198062 | 1113 | -NSD | KLIPRKT-KDIYL-DPKKYGGFDSPIVAYSV-LVVAD--IK--KGKAQKLKTVTELLGITIME | RSRFEK | 1177 |
| WP_050201642 | 1113 | -NSD | KLIPRKT-KDIYL-DPKKYGGFDSPIVAYSV-LVVAD--IK--KGKAQKLKTVTELLGITIME | RFRFEK | 1177 |
| WP_050204027 | 1113 | -NSD | KLIPRKT-KDIYL-DPKKYGGFDSPIVAYSV-LVVAD--IK--KGKAQKLKTVTELLGITIME | RFRFEK | 1177 |
| WP_050881965 | 1113 | -NSD | KLIPRKT-KDIYL-DPKKYGGFDSPIVAYSV-LVVAD--IK--KGKAQKLKTVTELLGITIME | RSRFEK | 1177 |
| WP_050886065 | 1113 | -NSD | KLIPRKT-KDIYL-DPKKYGGFDSPIVAYSV-LVLAD--IK--KGKAQKLKTVTELLGITIME | RERFEK | 1177 |
| AHN30376 | 1113 | -NSD | KLIPRKT-KDIYL-DPKKYGGFDSPIVAYSV-LVVAD--IK--KGKAQKLKTVTELLGITIME | RSRFEK | 1177 |
| EA078426 | 1113 | -NSD | KLIPRKT-KNSYW-NPKKYGGFDSPVVAYSI-LVFAD--VE--KGVKKKETMVLEFQGISLLD | RSRFEK | 1177 |
| CCW42055 | 1123 | -DSS | ENLVGVK-RNL---DPKKYGGYAGISNSYAV-LVKAI--IE--KGVKKKETMVLEFQGISLLD | RITFEK | 1185 |
| WP_003041502 | 1095 | -ESD | KLIPRKT-KNSYW-NPKKYGGFDSPVVAYSI-LVFAD--VE--KGKSKKLRKVQDMVGITIME | KKRFEK | 1159 |
| WP_037593752 | 1095 | -ESD | KLIPRKT-KNSYW-NPKKYGGFDSPVVAYSI-LVFAD--VE--KGKSKKLRKVQDMVGITIME | KKRFEK | 1159 |
| WP_049516684 | | | | | |

-continued

| | | | | | |
|---|---|---|---|---|---|
| GAD46167 | 1094 | -ESD | KLIPRKT-KNSYW-NPKKYGGPFDSPVVAYSI-LVFAD--VE--KGKSKKLRKVQDMVGITIME | KKRFEK | 1158 |
| WP_018363470 | 1126 | -DSD | KLIPRTkKV-LtW-EPKKYGGPFDSPTVAYSI-LVVAD--VE--KGKTKKLKTVKELVGISIME | RSFFEK | 1190 |
| WP_003043819 | 1124 | -ESA | KLIP----RKKGW-DTRKYGGFGSPTVAYSI-LVVAK--VE--KGKAKKLKSVKVLVGITIME | KGSYEK | 1185 |
| WP_006269958 | 1094 | -ESD | KLIPRKT-KNSYW-DPKKYGGPFDSPTVAYSI-LVFAD--VE--KGKSKKLRKVQDMVGITIME | KKRFEK | 1158 |
| WP_048800889 | 1114 | -DSD | KLIARKTkEN-YW-DTKKYGGPFDSPTVAYSI-LVVAD--IK--KGKAKKLKTVKELVGISIME | RPFFEK | 1178 |
| WP_012767106 | 1114 | -SFD | RKHRF-ESSKYGGPFGSPTVTYSV-LVVAKsKVQ--DGKVKKIKTGKELIGMTLLD | KLVFEK | 1177 |
| WP_014612333 | 1114 | -SFD | KLIS----RKHRF-ESSKYGGPFGSPTVTYSV-LVVAKsKVQ--DGKVKKIKTGKELIGITLLD | KLVFEK | 1177 |
| WP_015017095 | 1114 | -SFD | KLIS----RKHRF-ESSKYGGPFGSPTVTYSV-LVVAKsKVQ--DGKVKKIKTGKELIGITLLD | KLVFEK | 1177 |
| WP_015057649 | 1114 | -SFD | KLIS----RKHRF-ESSKYGGPFGSPTVTYSV-LVVAKcKVQ--DGKVKKIKTGKELIGITLLD | KLVFEK | 1177 |
| WP_048272215 | 1114 | -SFD | KLIS----RKHRF-ESSKYGGPFGSPTVTYSV-LVVAKsKVQ--DGKVKKIKTGKELIGITLLD | KLVFEK | 1177 |
| WP_049519324 | 1114 | -SFD | KLIS----RKHRF-ESSKYGGPFGSPTVTYSV-LVVAKsKVQ--DGKVKKIKTGKELIGITLLD | KLVFEK | 1177 |
| WP_012515931 | 1095 | -NSD | KLIP----RKNNW-DTRKYGGPFDSPTVAYSV-LVIAK--ME--KGKAKVLKPVKEMVGITIME | RTAFEE | 1156 |
| WP_021320964 | 1095 | -NSD | KLIP----RKNNW-DTRKYGGPFDSPTVAYSV-LVIAK--ME--KGKAKVLKPVKEMVGITIME | RIAFEE | 1156 |
| WP_037581760 | 1095 | -NSD | KLIP----RKNNW-DTRKYGGPFDSPTVAYSV-LVIAK--ME--KGKAKVLKPVKEMVGISIME | RIAFEE | 1156 |
| WP_004232481 | 1124 | -DSD | KLIPRTkKL-QW-ETQKYGGPFDSPTVAYSV-FVVAD--VE--KGKTRKLKTVKELVGISIME | RSSFEE | 1188 |
| WP_009854540 | 1119 | -DSD | KLIPRTkKV-YW-DTPKYGGPFDSPNIAYSV-LVIAD--VE--KGKAKKLKTVKELVGISIME | RSFFEE | 1183 |
| WP_012962174 | 1120 | -NSD | KLIPRKT-kKF-RW-DTPKYGGPFDSPTVAYSV-FVIAD--VE--KGKAKKLKTVKELVGISIME | RSSFEE | 1184 |
| WP_039695303 | 1121 | -DSD | KLIPRTkKV-YW-DTKKYGGPFDSPTVAYSV-FVVAD--VE--KGKAKKLKTVKELVGISIME | RSFFEE | 1185 |
| WP_014334983 | 1124 | -DSD | KLIPRTkKV-YW-NTKKYGGPFDSPTVAYSV-LVVAD--IE--KGKAKKLKTVKELVGISIME | RSFFEE | 1188 |
| WP_003099269 | 1115 | -DSD | KLIA----RKSW-DPKKYGGPFDSPTIAYSV-LVVAK--IA--KGKTQKLKTIKELVGIKIME | QDEFEK | 1176 |
| AHYI5608 | 1115 | -DSD | KLIA----RKSW-DPKKYGGPFDSPTIAYSV-LVVAK--IA--KGKTQKLKTIKELVGIKIME | QDEFEK | 1176 |
| AHY17476 | 1 | | ME | QDEFEK | 8 |
| ESR09100 | 1115 | -DSD | KLIA----RKKSW-DPKKYGGPFDSPTIAYSV-LVVAK--IA--KGKTQKLKTIKELVGIKIME | RTIFEK | 1176 |
| AGM98575 | 1094 | -NSD | KLIPRKT-KKFYW-DTKKYGGPFDSPIIAYSV-LVVAN--IE--KGKSKKLKIVKDLVGITIME | KKDYEK | 1158 |
| ALF27331 | 1109 | -NN- | KLIP----RKKDW-SVDKYGGFIEPAESYSLaIFYTD--IN----GKKPKKKSTIIAISRME | KAAFEE | 1167 |
| WP_018372492 | 1125 | vvDAS | KLTPIKS-G---L-SPEKYGGYARPTIAYSV-LLIAD--IE--KGKAKKLRIKEMVGITVQD | KMTFEK | 1188 |
| WP_045618028 | 1119 | -DSD | KLIPRKT-KDILL-DTTKYGGPFDSPTVAYSI-LLIAD--IE--KGKSKKLKTVKTLVGITIME | KMTFER | 1183 |
| WP_045635197 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002263887 | 1094 | -DSD | KLIPRKT-KKFYW-DTKKYGGPFDSPIVAYSI-LVIAD--IE--KGKSKKLKTVKALVGVTIME | KMTFER | 1158 |
| WP_002264920 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002269043 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002269448 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002271977 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002272766 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002273241 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002275430 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002276448 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002277050 | 1112 | -PLE | KLVPLKK----AL-NPEKYGGYQKPTAYPI-LLIVD-----------TKQLIPISVMD | KKRFEQ | 1166 |
| WP_002773364 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002779025 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002279859 | 1094 | -DSD | KLIPRKT-KKFYW-DTKKYGGPFDSPIVAYSI-LVIAD--IE--KGKSKKLKTVKALVGVTIME | KMTFER | 1158 |
| WP_002280230 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002281696 | 1112 | -PLE | KLVPLKK----AL-NPEKYGGYQKPTAYPI-LLIVD-----------TKQLIPISVMD | KKRFEQ | 1166 |
| WP_002282247 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002283846 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002287255 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002288990 | 1094 | -NSY | KLIPRKT-KKFYW-DTKKYGGPFDSPIVAYSI-LVIAD--IE--KGKSKKLKTVKALVGVTIME | KMTFER | 1158 |
| WP_002289641 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002290427 | 1094 | -DSD | KLIPRKT-KKFYW-DTKKYGGPFDSPIVAYSI-LVIAD--IE--KGKSKKLKTVKALVGVTIME | KMTFER | 1158 |
| WP_002295753 | 1094 | -NSD | KLIPRKT-KKFYW-DTKKYGGPFDSPIVAYSI-LVIAD--IE--KGKSKKLKTVKALVGVTIME | KMTFER | 1158 |
| WP_002296423 | 1094 | -NSD | KLIPRKT-KKFYW-DTKKYGGPFDSPIVAYSI-LVIAD--IE--KGKSKKLKTVKALVGVTIME | KMTFER | 1158 |

```
-continued

WP_002304487  1108  --NSD  KLIPRKT-KKFYW-DTKKYGGFDSPIVAYSI-LVIAD--IE--KGKSKKLKTVKALVGVTIME  KMTFER  1172
WP_002305844  1094  --NSD  KLIPRKT-KKFYW-DTKKYGGFDSPIVAYSI-LVIAD--IE--KGKSKKLKTVKALVGVTIME  KMTFER  1158
WP_002307203  1094  --NSD  KLIPRKT-KKFYW-DTKKYGGFDSPIVAYSI-LVIAD--IE--KGKSKKLKTVKALVGVTIME  KMTFER  1158
WP_002310390  1094  --DSD  KLIPRKT-KKFYW-DTKKYGGFDSPIVAYSI-LVIAD--IE--KGKSKKLKTVKALVGVTIME  KMTFER  1158
WP_002352408  1094  --NSD  KLIPRKT-KKFYW-DTKKYGGFDSPIVAYSI-LVIAD--IE--KGKSKKLKTVKALVGVTIME  KMTFER  1158
WP_012997688  1094  --NSD  KLIPRKT-KKFYW-DTKKYGGFDSPIVAYSI-LVIAD--IE--KGKSKKLKTVKALVGVTIME  KMTFER  1158
WP_014677909  1094  --NSD  KLIPRKT-KKFYW-DTKKYGGFDSPIVAYSI-LVIAD--IE--KGKSKKLKTVKALVGVTIME  KMTFER  1158
WP_019312892  1094  --NSD  KLIPRKT-KKFYW-DTKKYGGFDSPIVAYSI-LVIAD--IE--KGKSKKLKTVKALVGVTIME  KMTFER  1158
WP_019313659  1094  --NSD  KLIPRKT-KKFYW-DTKKYGGFDSPIVAYSI-LVIAD--IE--KGKSKKLKTVKALVGVTIME  KMTFER  1158
WP_019314093  1094  --NSD  KLIPRKT-KKFYW-DTKKYGGFDSPIVAYSI-LVIAD--IE--KGKSKKLKTVKALVGVTIME  KMTFER  1158
WP_019315370  1094  --NSD  KLIPRKT-KKFYW-DTKKYGGFDSPIVAYSI-LVIAD--IE--KGKSKKLKTVKALVGVTIME  KMTFER  1158
WP_019803776  1094  --DSD  KLIPRKT-KKFYW-DTKKYGGFDSPIVAYSI-LVIAD--IE--KGKSKKLKTVKALVGVTIME  KMTFER  1158
WP_019805234  1094  --NSD  KLIPRKT-KKFYW-DTKKYGGFDSPIVAYSI-LVIAD--IE--KGKSKKLKTVKALVGVTIME  KMTFER  1158
WP_024783594  1094  --NSD  KLIPRKT-KKFYW-DTKKYGGFDSPIVAYSI-LVIAD--IE--KSKSKKLKTVKALVGVTIME  KMTFER  1158
WP_024784288  1112  --PLE  KLVPLKK----AL-NPEKYGGYQKPTTAYPI-LLIVD---------TKQLIPISVMD       KKRFEQ  1166
WP_024784666  1094  --NSD  KLIPRKT-KKFYW-DTKKYGGFDSPIVAYSI-LVIAD--IE--KGKSKKLKTVKALVGVTIME  KMTFER  1158
WP_024784894  1094  --NSD  KLIPRKT-KKFYW-DTKKYGGFDSPIVAYSI-LVIAD--IE--KGKSKKLKTVKALVGVTIME  KMTFER  1158
WP_024786433  1112  --PLE  KLVPLKK----AL-NPEKYGGYQKPTTAYPI-LLIVD---------TKQLIPISVMD       KKRFEQ  1166
WP_049473442  1094  --NSD  KLIPRKT-KKFYW-DTKKYGGFDSPIVAYSI-LVIAD--IE--KGKSKKLKTVKALVGVTIME  KMTFER  1158
WP_049474547  1094  --NSD  KLIPRKT-KKFYW-DTKKYGGFDSPIVAYSI-LVIAD--IE--KGKSKKLKTVKALVGVTIME  KMTFER  1158
EMC03581      1087  --NSD  KLIPRKT-KKFYW-DTKKYGGFDSPIVAYSI-LVIAD--IE--KGKAKRLKTVKTLVGITIME  KMTFER  1151
WP_000428612  1122  --NSD  KLIPRKT-KDILW-DTTKYGGFDSPVIAYSI-LLIAD--IE--KGKAKKLKTVKTLVGITIME  KATFEK  1186
WP_000428613  1120  --NSD  KLIPRKT-KDILW-ETTKYGGFDSPVIAYSI-LLIAD--IE--KGKAKKLKTVKTLVGITIME  KAAFEE  1184
WP_049523028  1115  --NSD  KLIPRKT-KNVQL-DTTKYGGFDSPTVAYSV-LVVAK--VE--KGKSKKLKSVKELLGITIME  KVKFEA  1179
WP_003107102  1084  --DSD  KLIP---RKNNW-DPKKYGGFGSPIIAYSV-LVVAK--VT--KGKSQKTKSVKELVGITIME  QNEFEK  1145
WP_054279288  1116  --KSS  KLIP---RKNKWrDTTKYGGENTPVAYSV-LVVAK--VE--KGKAKKLKPVKELVGITIME  RTKFEA  1178
WP_049531101  1125  vvDAS  KLIPIKS-G---L-SPEKYGGYARPTIAYSV-LVIAD--IE--KGKAKKLKRIKEMVGITIQD  KKKFEA  1188
WP_049538452  1125  vvDAS  KLIPIKS-G---L-SPEKYGGYARPTIAYSV-LVIAD--IE--KGKYTKKLKRIKEMVGITIQD  KKIFES  1188
WP_049549711  1127  vvDAS  KLIPIKS-G---L-SPEKYGGYARPTIAYSV-LVIAD--IE--KGKTKKLKRIKEMVGITIME  KKKFEA  1190
WP_007896501  1121  --NSD  KLIE---RKKGW-DPKKYGGFDSPNTAYSI-FVVAK--VA--KRKAQKLKTVKELVGITIME  QAEYEK  1182
EFR44625      1073  --NSD  KLIE---RKKGW-DPKKYGGFDSPNTAYSI-FVVAK--VA--KRKAQKLKTVKTLVGITIME  QAEYEK  1134
WP_002897777  1119  --NSD  KLIPRKT-KDILW-DTTKYGGFDSPVIAYSI-LVIAD--IE--IEkgKKGKAKKLKSVKELLGITIME  KAAFEE  1183
WP_002906454  1124  vvDAS  KLIPIKS-S---L-SPEKYGGYARPTIAYSV-LVVAK--VE--KGKAKKLKRIKEIVGITIQD  KKKFES  1189
WP_009729476  1120  --NSD  KLIPRKT-KDILW-DTTKYGGFDSPVIAYSI-LLIAD--IE--KGKSKRLKTVKEMIGITIME  KDAFEK  1184
CQR24647      1110  --GSD  KLIARKT-KNNYL-STQKYGGFDSPTVAYSI-MFVAD--IE--KGKSKKLKTVKTLVGITIME  RSRFES  1174
WP_000066813  1124  --NSD  KLIPRKT-KEILW-DTTKYGGFDSPVIAYSI-LLIAD--IE--KGKAKKLKTVKTLVGITIME  KATFEK  1188
WP_009754323  1120  --NSD  KLIPRKT-KDILW-DTTKYGGFDSPVIAYSI-LLIAD--IE--KGKAKKLKTVKTLVGITIME  KAAFEK  1184
WP_044674937  1113  --DSD  KLIP----EKFYL-DTKKYGGFDSPTIAYSV-LLIAD--IE--KGKAKKLKRVKELIGITIME  RMAFEK  1177
WP_044676715  1115  --DSD  KLIPRKT-EKFYL-DTKKYGGFDSPTIAYSV-LLIAD--IE--KGKAKKLKRVKELIGITIME  RMAFEK  1179
WP_044680361  1113  --DSD  KLIPRKT-EKFYL-DTKKYGGFDSPTIAYSV-LLIAD--IE--KGKAKKLKRVKELIGITIME  RMAFEK  1179
WP_044681799  1113  --DSD  KLIPRKT-EKFYL-DTKKYGGFDSPTIAYSV-LLIAD--IE--KGKAKKLKRVKELIGITIME  RMAFEK  1177
WP_049533112  1123  --DSS  ENLVGVK-RNL---DPKKYGGYAGISNSYAV-LVKAI--IE--KGVKKKETMVLEFQGISILD  RITFEK  1185
WP_029090905  1062  --SSS  KTIP----LKKHL-DTAIYGGYTAVNYASYA---LIQ--FK---KGRKLK--REIIGIPLAV  QTRIDN  1117
WP_066506696  1085  haDKG  AVVP----VNKNRS-DVHKYGGFSG--LQYTI---VA--IEggKKKGKKTELVKKILSGVPLHL  KAASIN  1149
AIT42264      1124  --NSD  KRKDW-DPKKYGGFDSPTVAYSV-LVVAK--VE--KGKSKKLKSVKELLGITIME  RSSFEK  1176
WP_034440723  1093  k-KTE  KRIP----IKNNL-DPNIYGGYIEEKMAYYI---AlmyLB-NGKTKK---AIVGISIKD  KKDFEG  1149
AKQ21048      1115  --NSD  KLIA----RKKDW-DPKKYGGFDSPTVAYSV-LVVAK--VE--KGKSKKLKELLGITIME  RSSFEK  1176
WP_004636532  1093  --DSS  KLIA----VKEGM-DPQKYGGLSQVSEAFAV-VIT----HE--KGKKKQLK--SDLISIPIVD  QKAYEQ  1150
WP_002364836  1099  --DSD  KLIP----VKNGL-DPQKYGGFDSPIVAYTV-LF---T--HE--KGK-KPL-IKQEILGITIME  KTRFEQ  1156
WP_016631044  1099  --PSN  KLIP----VKNGL-DPQKYGGFDSPVVAYTV-LF---T--HE--KGK-KPL-IKQEILGITIME  KTRFEQ  1156
EM575795      835   --KPD  KLIQ----RKAGW-DVSKYGGFGSPVVAYAV-AFI----VE--KGKAR--KKAKAIEGIIMK  QSLFEQ  892
WP_002373311  1099  --PSN  KLIP----VKNGL-DPQKYGGFDSPIVAYTV-LF---T--HE--KGK-KPL-IKQEILGITIME  KTRFEQ  1156
WP_002378009  1099  --PSN  KLIP----VKNGL-DPQKYGGFDSPIVAYTV-LF---T--HE--KGK-KPL-IKQEILGITIME  KTRFEQ  1156
```

-continued

| ID | | | | | |
|---|---|---|---|---|---|
| WP_002407324 | 1099 | -PSN | KLIP----VKNGL-DPQKYGGFDSPIVAYTV-LF--T--HE--KGK-KPL-IKQEILGITIME | KTRFEQ | 1156 |
| WP_002413717 | 1099 | -PSN | KLIP----VKNGL-DPQKYGGFDSPIVAYTV-LF--T--HE--KGK-KPL-IKQEILGITIME | KTRFEQ | 1156 |
| WP_010775580 | 1101 | -PSN | KLIP----VKNGL-DPQKYGGFDSPVVAYTV-LF--T--HE--KGK-KPL-IKQEILGITIME | KTRFEQ | 1158 |
| WP_010818269 | 1099 | -PSN | KLIP----VKNGL-DPQKYGGFDSPIVAYTV-LF--T--HE--KGK-KPL-IKQEILGITIME | KTRFEQ | 1156 |
| WP_010824395 | 1099 | -PSN | KLIP----VKNGL-DPQKYGGFDSPVVAYTV-LF--T--HE--KGK-KPL-IKQEILGITIME | KTRFEQ | 1156 |
| WP_016622645 | 1099 | -PSN | KLIP----VKNGL-DPQKYGGFDSPIVAYTV-LF--T--HE--KGK-KPL-IKQEILGITIME | KTRFEQ | 1156 |
| WP_033624816 | 1099 | -PSN | KLIP----VKNGL-DPQKYGGFDSPIVAYTV-LF--T--HE--KGK-KPL-IKQEILGITIME | KTKFEQ | 1156 |
| WP_033625576 | 1099 | -PSN | KLIP----VKNGL-DPQKYGGFDSPVVAYTV-LF--T--HE--KGK-KPL-IKQEILGITIME | KTRFEQ | 1156 |
| WP_033789179 | 1099 | -PSN | KLIP----VKNGL-DPQKYGGFDSPVVAYTV-LF--T--HE--KGK-KPL-IKQEILGITIME | KTRFEQ | 1156 |
| WP_002310644 | 1101 | -DSS | KLLP----RKNNW-DPAKYGGLGSPNMAYTV-AFT--YE--KGKAR-KRTNALEGITIME | REAFEQ | 1158 |
| WP_002312694 | 1102 | -DSS | KLLP----RKNNW-DPAKYGGLGSPNMAYTV-AFT--YE--KGKAR-KRTNALEGITIME | REAFEQ | 1159 |
| WP_002314015 | 1102 | -DSS | KLLP----RKNNW-DPAKYGGLGSPNMAYTV-AFT--YE--KGKAR-KRTNALEGITIME | REAFEQ | 1159 |
| WP_002320716 | 1102 | -DSS | KLLP----RKNNW-DPAKYGGLGSPNMAYTV-AFT--YE--KGKAR-KRTNALEGITIME | REAFEQ | 1159 |
| WP_002330729 | 1101 | -DSS | KLLP----RKNNW-DPAKYGGLGSPNMAYTV-AFT--YE--KGKAR-KRTNALEGITIME | REAFEQ | 1158 |
| WP_002335161 | 1102 | -DSS | KLLP----RKNNW-DPAKYGGLGSPNMAYTV-AFT--YE--KGKAR-KRTNALEGITIME | REAFEQ | 1159 |
| WP_002345439 | 1102 | -DSS | KLLP----RKNNW-DPTKYGGLGSPNMAYTV-AFT--YE--KGKAR-KRTNALEGITIME | REAFEQ | 1159 |
| WP_034867970 | 1092 | -KPD | KLIE----RKNNW-DVTKYGGFGSPVIAYAI-AFV--YA--KGKTQ-KKTRAIEGITIME | QAAFEQ | 1149 |
| WP_047937432 | 1102 | -DSS | KLLP----RKNNW-DPAKYGGLGSPNMAYTV-AFT--YE--KGKAR-KRTNALEGITIME | REAFEQ | 1159 |
| WP_010720994 | 1092 | -KPD | KLIE----RKNNW-DVTKYGGFGSPVIAYAI-AFV--YA--KGKTQ-KKTRAIEGITIME | QAAFEK | 1149 |
| WP_010737004 | 1092 | -KPD | KLIE----RKNNW-DVTKYGGFGSPVIAYAI-AFV--YA--KGKTQ-KKTRAIEGITIME | QAAFEK | 1149 |
| WP_034700478 | 1092 | -KPD | KLIE----RKNNW-DVTKYGGFGSPVIAYAI-AFV--YA--KGKTQ-KKTRAIEGITIME | QAAFEK | 1149 |
| WP_007209003 | 1090 | -ESQ | KLIR----RKQQW-NTKKYGGFDSPVVAYAI--LLS--FD--KGK-RKARSFK-IVGITIQD | RESFEG | 1147 |
| WP_023519017 | 1086 | -NPE | KLIP----RKASL-DPLKYGGFDSPVQVAYSV-IFI--FE--KGHQK--KVTKGIEGITVME | QLRFEQ | 1143 |
| WP_017770040 | 1097 | -DSD | KLIS----RKTNW-DPIKYGGFDSPNMAYSV-VI--T--YE--KGK-KKVRA-KAIVGITIME | QSLFKK | 1154 |
| WP_048604708 | 1094 | -DSD | KLIS----RKKEW-DTTKYGGFDSPNMAYSV-VI--R--YE--KGK-TRKLV-KTIVGITIME | RAAFEK | 1151 |
| WP_010750235 | 1095 | -KPD | KLIK----RKNNW-DVTKYGGFGSPVYAYAV-VFT--YE--KGKNH-KKAKAIEGITIME | QALFEK | 1152 |
| AII16583 | 1154 | -NSD | KLIA----RKKDW-DPTKYGGSPTVAYSV-LVVAK--VE--KGKSKKLKSVKELLGITIME | RSSFEK | 1215 |
| WP_029073316 | 1100 | hsEKG | AKVP----vNKLRS-NVHKYGGFPEG--LKYSI---VA--IKgkKKKgKKLIDVNKLVGIPLMY | KNVDDE | 1164 |
| WP_031589969 | 1100 | nsDKD | ATVP----vNKYRS-NVNKYGGFSG--VNSFI---VA--IKgkKKKgKKKIEVKGKTKKVKT--LVNIPIID | KNADEE | 1164 |
| KDA45870 | 1079 | -DSG | KLLP----RKEGL-DPVKYGYAKAVESYAV-LITAD-eVK--KGKTKKVKT--LVNIPIID | SKKYEA | 1138 |
| WP_039099354 | 1098 | k-ASG | QLIPAKQdRPTAL--YGGYSGKTVAYMC---IVR--IKnkKGDLYKVCGVETSWLAQLKQ | KKKAFLK | 1170 |
| AKP02966 | 1119 | k---- | KLIA----QKKDM-DENIYGGFSGDNKSSIT--IVK--ID---NNKIKPVA--IPIRLIN | ---DK | 1172 |
| WP_010991369 | 1096 | -NSS | KLIP----RKTNW-DPMKYGGLDSPNMAYAV-VI--E--YA--KGK-NKLVFEKKI-IRVTIME | RKAFEK | 1154 |
| WP_033838504 | 1096 | -NSS | KLIS----RKTNW-DPMKYGGLDSPNMAYAV-VI--E--YA--KGK-NKLVFEKKI-IRVTIME | RKAFEK | 1154 |
| EHN60060 | 1099 | -NSS | KLIS----RKTNW-DPMKYGGLDSPNMAYAV-VI--E--YA--KGK-NKLVFEKKI-IRVTIME | RKAFEK | 1157 |
| EFR89594 | 865 | -NSS | KLIS----RKADW-DPMKYGGLDSPNMAYAV-VI--E--YA--KGK-NKLVFEKKI-IRVTIME | RKAFEK | 923 |
| WP_038409211 | 715 | -NSS | KLIS----RKADW-NPIKYGGFDGSNMAYSI-VI--E--YE--KRK-KKTVIKKELIQINIME | RVAFEK | 773 |
| EFR95520 | 1096 | -NSS | KLIP----RKENW-DPMKYGGLDSPNMAYSI-VI--E--HA--KGK-KKIVIEKKLIQINIME | RVAFEK | 1154 |
| WP_003723650 | 1096 | -NSS | KLIP----RKENW-DPMKYGGLDSPNMAYAV-II--E--HA--KGK-KKIVIEKKLIQINIME | RKMFEK | 1154 |
| WP_003727705 | 1096 | -NSS | KLIP----RKENW-DPMKYGGLDSPNMAYAV-II--E--HA--KGK-KKIVIEKKLIQINIME | RKMFEK | 1154 |
| WP_003730785 | 1096 | -NSS | KLIP----RKENW-DPMKYGGLDSPNMAYAV-II--E--HA--KGK-KKIVIEKKLIQINIME | RKMFEK | 1154 |
| WP_003733029 | 1096 | -KSN | KLIP----RKKDW-DPIKYGGFDGSKMAYAI-II--E--YA--KGK-KKVFEKKI-IRITIME | REAFEK | 1154 |
| WP_003739838 | 1096 | -NSS | KLIP----RKTNW-DPMKYGGLDSPNMAYAV-VI--E--YA--KGK-NKLVFEKKI-IRVTIME | RKAFEK | 1154 |
| WP_014601172 | 1096 | -NSS | KLIP----RKTNL-NPIKYGGFPEGSNMAYAI-II--E--YE--KGK-KKTIEKKLIRITIME | RKMFEK | 1154 |
| WP_023548323 | 1096 | -DSS | KLIP----RKTNL-NPIKYGGFPEGSNMAYAI-VI--E--HA--KGK-KKTIEKKLIRITIME | RKMFEK | 1154 |
| WP_031665337 | 1096 | -NSS | KLIP----RKQW-DPIKYGGFDGSKMAYAI-II--E--YE--KQK-RKVRIEKKLIQINIME | RKAFEK | 1154 |
| WP_031669209 | 1096 | -KSN | KLIP----RKENW-DPMKYGGFEGSNMAYAI-II--E--HE--KRK-KKLIFEKKI-IRITIME | RKAFEK | 1154 |
| WP_033920898 | 1099 | -NSS | KLIP----RKENW-DPMKYGGLDSPNMAYAV-II--E--HA--KGK-KKLIFEKKI-IRITIME | RKMFEK | 1157 |
| AKI42028 | 1099 | -NSS | KLIP----KKTNL-NPIKYGGFPEGSNMAYAI-VI--E--HE--KGK-KRIVIKKELIQINIME | RKMFEK | 1157 |
| AKI50529 | 544 | -DSS | KLIP----KKTNL-NPIKYGGFEGSNMAYAI-II--E--HE--KRK-KKTVIKKELIQINIME | RKMFEK | 602 |
| EFR83390 | 1096 | -NSS | KLIP----RKKDW-DPIKYGGFDGSKMAYAI-II--E--HA--KGK-KKIVIKKELIQINIME | RTAFEK | 1154 |
| WP_046323366 | 1131 | -NSD | KLIA----RRKKDW-DPKKYGGFDSPTVAYSV-LVVAK--VE--KGKSKKLKSVKELLGITIME | RSSFEK | 1192 |
| AKE81011 | | | | | |

```
CU082355        1089  hsAKG  AVIP---vNKNRK-DVNKYGGFPSG--LQYVI----AA--IEgtKKKGKKLVKRKLSGIPLYL                       KQADIK  1153
WP_033162887    1090  hsBKG  ATVP---lNKYRA-DVHKYGGFGCN--VQSII----VA--IEgkKKKKGKKLIDVRKLTSIPLHL                       KNAPVE  1154
AGZ01981        1148  --NSD  KLIA----RKKDW-DPKKYGGFDSPTVAYSV-LVVAK--VE--KGSKKKLKSVKELLGITIME                       RSSFEK  1209
AKA60242        1115  --NSD  KLIA----RKKDW-DPKKYGGFDSPTVAYSV-LVVAK--VE--KGSKKKLKSVKELLGITIME                       RSSFEK  1176
AKS40380        1115  --NSD  KLIA----RKKDW-DPKKYGGFDSPTVAYSV-LVVAK--VE--KGKSKKLKSVKELLGITIME                       RSSFEK  1176
4UN5_B          1119  --NSD  KLIA----RKKDW-DPKKYGGFDSPTVAYSV-LVVAK--VE--KGKSKKLKSVKELLGITIME                       RSSFEK  1180

WP_010922251    1177  NPI---DFLE--AKGYKE--NKGYHN--I-REDKLIK-LPKYSLFE--LENGRKRMLAS  -GELQKGNELALPSKVNFLYLA              1239
WP_039695303    1186  NPV---EFLE--AKGYKE--NKGYHN--I-REDKLIK-LPKYSLFE--FEGGRRRLLAS  ASELQKGNEMVLPGYIVELLYHA             1248
WP_045635197    1184  NPI---TFLE--NKGYHN--V-RKENILC-LPKYSLFE--LENGRRRLLAS           AKELQKGNEIVLPVYLJTLLYHS            1246
5AXW_A          913   KPYrfdVVLD-NGVVKFptV-KNLDVIK---KENYYE--VNSKAYEEAKK           -KKISNQAEFIASFYNNDLIKIN            978
WP_099880683    861   DPV---DFLE--AKGYKE--V-RKDLIIK-LPKYSLFE--LENGRKRMLAS           -GELQKGNELALPSKYVNFLYLA            923
WP_010922211    1177  NPI---DFLE--AKGYKE--V-RKDLIIK-LPKYSLFE--LENGRKRMLAS           -GELQKGNELALPSKYVNFLYLA            1239
WP_011054416    1177  NPI---DFLE--AKGYKE--V-RKDLIIK-LPKYSLFE--LENGRKRMLAS           -GELQKGNELALPSKYVNFLYLA            1239
WP_011284745    1177  DPI---DFLE--AKGYKE--V-RKDLIVK-LPKYSLFE--LENGRKRMLAS           -GELQKGNELALPSKYVNFLYLA            1239
WP_011285506    1177  NPI---DFLE--AKGYKE--V-RKDLIIK-LPKYSLFE--LENGRKRMLAS           -GELQKGNELALPSKYVNFLYLA            1239
WP_011527619    1177  NPI---DFLE--AKGYKE--V-RKDLIIK-LPKYSLFE--LENGRKRMLAS           -GELQKGNELALPSKYVNFLYLA            1239
WP_012560673    1177  DPV---DFLE--AKGYKE--V-RKDLIIK-LPKYSLFE--LENGRKRMLAS           -GELQKGNELALPSKYVNFLYLA            1239
WP_014407541    1176  NPI---DFLE--AKGYKE--V-KKDLIIK-LPKYSLFE--LENGRKRMLAS           -GELQKGNELALPSKYVNFLYLA            1238
WP_020905136    1177  NPI---DFLE--AKGYKE--V-KKDLIIK-LPKYSLFE--LENGRKRMLAS           -GELQKGNELALPSKYVNFLYLA            1239
WP_023080005    1176  NPI---DFLE--AKGYKE--V-RKDLIIK-LPKYSLFE--LENGRKRMLAS           -GELQKGNELALPSKYVNFLYLA            1238
WP_023610282    1176  NPI---DFLE--AKGYKE--V-RKDLIIK-LPKYSLFE--LENGRKRMLAS           -GELQKGNELALPSKYVNFLYLA            1238
WP_030125963    1177  NPI---DFLE--AKGYKE--V-RKDLIIK-LPKYSLFE--LENGRKRMLAS           -GELQKGNELALPSKYVNFLYLA            1239
WP_030126706    1177  NPI---DFLE--AKGYKE--V-RKDLIIK-LPKYSLFE--LENGRKRMLAS           -GELQKGNELALPSKYVNFLYLA            1239
WP_031488318    1177  NPI---DFLE--AKGYKE--V-RKDLIIK-LPKYSLFE--LENGRKRMLAS           -GELQKGNELALPSKYVNFLYLA            1239
WP_032460140    1177  DPV---DFLE--AKGYKE--V-RKDLIIK-LPKYSLFE--LENGRKRMLAS           -GELQKGNELALPSKYVNFLYLA            1239
WP_032461047    1177  NPI---DFLE--AKGYKE--V-RKDLIIK-LPKYSLFE--LENGRKRMLAS           -GELQKGNELALPSKYVNFLYLA            1239
WP_032462016    1177  NPI---DFLE--AKGYKE--V-RKDLIIK-LPKYSLFE--LENGRKRMLAS           -GELQKGNELALPSKYVNFLYLA            1239
WP_032462936    1177  NPI---DFLE--AKGYKE--V-RKDLIIK-LPKYSLFE--LENGRKRMLAS           -GELQKGNELALPSKYVNFLYLA            1239
WP_032464890    1177  NPI---DFLE--AKGYKE--V-RKDLIIK-LPKYSLFE--LENGRKRMLAS           -GELQKGNELALPSKYVNFLYLA            1239
WP_033888930    1002  NPI---DFLE--AKGYKE--V-RKDLIIK-LPKYSLFE--LENGRKRMLAS           -GELQKGNELALPSKYVNFLYLA            1064
WP_038431314    1177  NPI---DFLE--AKGYKE--V-RKDLIIK-LPKYSLFE--LENGRKRMLAS           -GELQKGNELALPSKYVNFLYLA            1239
WP_038432938    1176  NPI---DFLE--AKGYKE--V-RKDLIIK-LPKYSLFE--LENGRKRMLAS           -GELQKGNELALPSKYVNFLYLA            1238
WP_038434062    1177  NPI---DFLE--AKGYKE--V-RKDLIIK-LPKYSLFE--LENGRKRMLAS           -GELQKGNELALPSKYVNFLYLA            1239
BAQ51233        1088  NPI---DFLE--AKGYKE--V-RKDLIIK-LPKYSLFE--LENGRKRMLAS           -GELQKGNELALPSKYVNFLYLA            1150
KGE60162        352   DPI---DFLE--AKGYKE--V-RKDLIIK-LPKYSLFE--LENGRKRMLAS           -GELQKGNELALPSKYVNFLYLA            414
KGE60856        115   NPI---DFLE--AKGYKE--V-RKDLIIK-LPKYSLFE--LENKRRRLLAS           -GELQKGNELALPSKYVNFLYLA            177
WP_029989955    1177  NPI---DFLE--QRGYRN--V-RLEKIIK-LPKYSLFE--LENKRRRLLAS           ARELQKGNELVIPQRFTTLLYHS            1239
WP_003030002    1159  HPV---EFLE--NKGYHN--I-REDKLIK-LPKYSLFE--FEGGKRRLLAS           ASELQKGNEMVIPGHLVKLLYHA            1221
WP_003065552    1187  NPV---DFLE--SKGYLN--I-RTDKLII-LPKYSLFE--LENGRRRLLAS           AGELQKGNELALPTQFMKFLYLA            1249
WP_001040076    1178  NPS---AFLE--SKGYLN--I-RDDKLMI-LPKYSLFE--LENGRRRLLAS           AGELQKGNELALPTQFMKFLYLA            1240
WP_001040078    1186  NPS---AFLE--SKGYLN--I-RADKLII-LPKYSLFE--LENGRRRLLAS           AGELQKGNELALPTQFMKFLYLA            1248
WP_001040080    1178  NPS---AFLE--SKGYLN--I-RADKLII-LPKYSLFE--LENGRRRLLAS           AGELQKGNELALPTQFMKFLYLA            1240
WP_001040081    1178  NPS---AFLE--SKGYLN--I-RADKLII-LPKYSLFE--LENGRRRLLAS           AGETIDRLQKGNELALPTQFMKFLYLA        1240
WP_001040083    1178  NPS---AFLE--SKGYLN--I-RADKLII-LPKYSLFE--LENGRRRLLAS           AGELQKGNELALPTQFMKFLYLA            1240
WP_001040085    1178  NPS---AFLE--SKGYLN--I-RADKLII-LPKYSLFE--LENGRRRLLAS           AGELQKGNELALPTQFMKFLYLA            1240
WP_001040087    1178  NPS---AFLE--SKGYLN--I-RDDKLMI-LPKYSLFE--LENGRRRLLAS           AGELQKGNELALPTQFMKFLYLA            1240
WP_001040088    1178  NPS---AFLE--SKGYLN--I-RADKLII-LPKYSLFE--LENGRRRLLAS           AGELQKGNELALPTQFMKFLYLA            1240
WP_001040089    1178  NPS---AFLE--SKGYLN--I-RDDKLMI-LPKYSLFE--LENGRRRLLAS           AGELQKGNELALPTQFMKFLYLA            1240
WP_001040090    1178  NPS---AFLE--SKGYLN--I-RADKLII-LPKYSLFE--LENGRRRLLAS           AGELQKGNELALPTQFMKFLYLA            1240
WP_001040091    1178  NPS---AFLE--SKGYLN--I-RADKLII-LPKYSLFE--LENGRRRLLAS           AGELQKGNELALPTQFMKFLYLA            1240
```

-continued

| ID | Start | Sequence | End |
|---|---|---|---|
| WP_001040092 | 1178 | NPS---AFLE---SKGYLN--I-RTDKLII--LPKYSLFE---LENGRRRLLAS AGELQKGNELALPTQYMKFLYLA | 1240 |
| WP_001040094 | 1178 | NPS---AFLE---SKGYLN--I-RDDKLMI--LPKYSLFE---LENGRRRLLAS AGELQKGNELALPTQFMKFLYLA | 1240 |
| WP_001040095 | 1178 | NPS---AFLE---SKGYLN--I-RTDKLII--LPKYSLFE---LENGRRRLLAS AGELQKGNELALPTQYMKFLYLA | 1240 |
| WP_001040096 | 1178 | NPS---AFLE---SKGYLN--I-RDDKLMI--LPKYSLFE---LENGRRRLLAS AGELQKGNELALPTQFMKFLYLA | 1240 |
| WP_001040097 | 1178 | NPS---AFLE---SKGYLN--I-RDDKLMI--LPKYSLFE---LENGRRRLLAS ADELQKGNELALPTQFMKFLYLA | 1240 |
| WP_001040098 | 1178 | NPS---AFLE---SKGYLN--I-RDDKLMI--LPKYSLFE---LENGRRRLLAS AGELQKGNELALPTQFMKFLYLA | 1240 |
| WP_001040099 | 1178 | NPS---AFLE---SKGYLN--I-RDDKLMI--LPKYSLFE---LENGRRRLLAS AGELQKGNELALPTQFMKFLYLA | 1240 |
| WP_001040100 | 1178 | NPS---AFLE---SKGYLN--I-RDDKLMI--LPKYSLFE---LENGRRRLLAS AGELQKGNELALPTQFMKFLYLA | 1240 |
| WP_001040104 | 1178 | NPS---AFLE---SKGYLD--I-RADKLII--LPKYSLFE---LENGRRRLLAS AGELQKGNELALPTQFMKFLYLA | 1240 |
| WP_001040105 | 1178 | NPS---AFLE---SKGYLN--I-RADKLII--LPKYSLFE---LENGRRRLLAS AGELQKGNELALPTQYMKFLYLA | 1240 |
| WP_001040106 | 1178 | NPS---AFLE---SKGYLN--I-RDDKLMI--LPKYSLFE---LENGRRRLLAS AGELQKGNELALPTQYMKFLYLA | 1240 |
| WP_001040107 | 1178 | NPS---AFLE---SKGYLN--I-RTDKLII--LPKYSLFE---LENGRRRLLAS AGELQKGNELALPTQYMKFLYLA | 1240 |
| WP_001040108 | 1178 | NPS---AFLE---SKGYLN--I-RDDKLMI--LPKYSLFE---LENGRRRLLAS AGELQKGNELALPTQYMKFLYLA | 1240 |
| WP_001040109 | 1178 | NPS---AFLE---SKGYLN--I-RDDKLMI--LPKYSLFE---LENGRRRLLAS AGELQKGNELALPTQFMKFLYLA | 1240 |
| WP_001040110 | 1178 | NPS---AFLE---SKGYLN--I-RDDKLMI--LPKYSLFE---LENGRRRLLAS AGELQKGNELALPTQFMKFLYLA | 1240 |
| WP_015058823 | 1178 | NPS---AFLE---SKGYLN--I-RTDKLII--LPKYSLFE---LENGRRRLLAS ADELQKGNELALPTQYMKFLYLA | 1240 |
| WP_017643650 | 1178 | NPS---AFLE---SKGYLN--I-RDDKLMI--LPKYSLFE---LENGRRRLLAS AGELQKGNELALPTQFMKFLYLA | 1240 |
| WP_017647151 | 1178 | NPS---AFLE---SKGYLN--I-RDDKLMI--LPKYSLFE---LENGRRRLLAS AGELQKGNELALPTQFMKFLYLA | 1240 |
| WP_017648376 | 1178 | NPS---AFLE---SKGYLN--I-RADKLII--LPKYSLFE---LENGRRRLLAS AGELQKGNELALPTQFMKFLYLA | 1240 |
| WP_017649527 | 1178 | NPS---AFLE---SKGYLN--I-RADKLII--LPKYSLFE---LENGRRRLLAS AGELQKGNELALPTQFMKFLYLA | 1240 |
| WP_017771611 | 1178 | NPS---AFLE---SKGYLN--I-RADKLII--LPKYSLFE---LENGRRRLLAS AGELQKGNELALPTQFMKFLYLA | 1240 |
| WP_017771984 | 1178 | NPS---AFLE---SKGYLN--I-RADKLII--LPKYSLFE---LENGRRRLLAS AGELQKGNELALPTQFMKFLYLA | 1240 |
| CFQ25032 | 1178 | NPS---AFLE---SKGYLN--I-RADKLII--LPKYSLFE---LENGRRRLLAS AGELQKGNELALPTQFMKFLYLA | 1240 |
| CFV16040 | 1178 | NPS---AFLE---SKGYLN--I-RADKLII--LPKYSLFE---LENGRRRLLAS AGELQKGNELALPTQFMKFLYLA | 1240 |
| KLJ37842 | 1178 | NPS---AFLE---SKGYLN--I-RDDKLMI--LPKYSLFE---LENGRRRLLAS AGELQKGNELALPTQFMKFLYLA | 1240 |
| KLJ72361 | 1192 | NPS---AFLE---SKGYLN--I-RDDKLMI--LPKYSLFE---LENGRRRLLAS AGELQKGNELALPTQFMKFLYLA | 1254 |
| KLL20707 | 1178 | NPS---AFLE---SKGYLN--I-RDDKLMI--LPKYSLFE---LENGRRRLLAS AGELQKGNELALPTQFMKFLYLA | 1240 |
| KLL42645 | 1178 | NPS---AFLE---SKGYLN--I-RDDKLMI--LPKYSLFE---LENGRRRLLAS AGELQKGNELALPTQFMKFLYLA | 1240 |
| WP_047207273 | 1178 | NPS---AFLE---SKGYLN--I-RDDKLMI--LPKYSLFE---LENGRRRLLAS AGELQKGNELALPTQFMKFLYLA | 1240 |
| WP_047209694 | 1178 | NPS---AFLE---SKGYLN--I-RDDKLMI--LPKYSLFE---LENGRRRLLAS AGELQKGNELALPTQFMKFLYLA | 1240 |
| WP_050198062 | 1178 | NPS---AFLE---SKGYLN--I-RADKLII--LPKYSLFE---LENGRRRLLAS AGELQKGNELALPTQFMKFLYLA | 1240 |
| WP_050201642 | 1178 | NPS---AFLE---SKGYLN--I-RDDKLMI--LPKYSLFE---LENGRRRLLAS AGELQKGNELALPTQFMKFLYLA | 1240 |
| WP_050204027 | 1178 | NPS---AFLE---SKGYLN--I-RDDKLMI--LPKYSLFE---LENGRRRLLAS AGELQKGNELALPTQYMKFLYLA | 1240 |
| WP_050881965 | 1178 | NLS---AFLE---SKGYLN--I-RDDKLMI--LPKYSLFE---LENGRRRLLAS AGELQKGNELALPTQFMKFLYLA | 1240 |
| WP_050886065 | 1178 | NPS---AFLE---SKGYLN--I-RTDKLII--LPKYSLFE---LENGRRRLLAS AGELQKGNELALPTQYMKFLYLA | 1240 |
| AHN30376 | 1178 | NPS---AFLE---SKGYLN--I-RADKLII--LPKYSLFE---LENGRRRLLAS AGELQKGNELALPTQFMKFLYLA | 1240 |
| EAO78426 | 1178 | NPS---AFLE---SKGYLN--I-RTDKLII--LPKYSLFE---LENGRRRLLAS AGELQKGNELALPTQFMKFLYLA | 1240 |
| CCW42055 | 1178 | NPS---AFLE---SKGYLN--I-RTDKLII--LPKYSLFE---LKDGSRRMLAS AGELQKGNELALPTQMKFLYLA | 1240 |
| WP_003041502 | 1186 | DKR---AFLL---GKGYKD--I-K--KIIE--LPKYSLFE---LKDGSRRMLAS RGEIHKGNELFVPQKFTTLLYHA | 1253 |
| WP_037593752 | 1160 | NPV---DFLE---QRGYRN--V-RLEKIIK--LPKYSLFE---LENKRRRLLAS ARELQKGNELVIPQRFTTLLYHS | 1222 |
| WP_049516684 | 1160 | HPV---DFLE---QRGYRN--V-RLEKIIK--LPKYSLFE---LENKRRRLLAS ARELQKGNELVIPQRFTTLLYHS | 1222 |
| GAD46167 | 1159 | NPV---DFLE---QRGYRN--V-RLEKIIK--LPKYSLFE---LENKRRRLLAS ARELQKGNELVIPQRFTTLLYHS | 1221 |
| WP_018363470 | 1191 | NPV---EFLK---NKGYQN--V-QEDKLMK--LPKYSLMK---FEGGRRRLLAS ATELQKGNEIMLSAHIVALLYHA | 1253 |
| WP_003043819 | 1186 | DPI---GFIE---AKGYKD--I-KKELIFK--LPKYSLFE---LENKRRRLLAS --ELQKANELVLPQHIVRLLYYT | 1248 |
| WP_006269658 | 1159 | NPV---DFLE---QRGYRN--V-RLEKIIK--LPKYSLFE---LENGRRRMLAS AKELQKGNELVIPQRFTTLLYHS | 1221 |
| WP_048800889 | 1179 | NPI---MFLE---SKGYRN--I-QKDKLIK--LPKYSLFE---FEGGRRRLLAS AVELQKGNEMVLPQYLNNLLYHA | 1241 |
| WP_012767106 | 1178 | NPL---KFIE---DKGYGN--V-QIDKCIK--LPKYSLFE---FENGTRRMLAS RGDLQKANEMFLPAKLVTLLY-- | 1245 |
| WP_014612333 | 1178 | NPL---KFIE---DKGYGN--V-QIDKCIK--LPKYSLFE---FENGTRRMLAS RGDLQKANEMFLPAKLVTLLY-- | 1245 |
| WP_015017095 | 1178 | NPL---KFIE---DKGYGN--V-QIDKCIK--LPKYSLFE---FENGTRRMLAS RGDLQKANEMFLPAKLVTLLY-- | 1245 |
| WP_015057649 | 1178 | NPL---KFIE---DKGYGN--V-QIDKCIK--LPKYSLFE---FENGTRRMLAS RGDLQKANEMFLPAKLVTLLY-- | 1245 |
| WP_048272215 | 1178 | NPL---KFIE---DKGYGN--V-QIDKCIK--LPKYSLFE---FENGTRRMLAS RGDLQKANEMFLPAKLVTLLY-- | 1245 |
| WP_049519324 | 1178 | NPL---KFIE---DKGYGN--V-QIDKCIK--LPKYSLFE---FENGTRRMLAS RGDLQKANEMFLPAKLVTLLY-- | 1245 |
| WP_012515931 | 1157 | NPV---VFLE---ARGYRE--I-QEHLIIK--LPKYSLFE---LENGRRRLLAS -SELQKGNELFLPVDYMTFLYLA | 1219 |

```
WP_021320964   1157 NPV---VFLE---AKGYRE--I-QEHLIIK--LPKYSLFE---LENGRRRLLAS -SELQKGNELFLPVDYMTFLYLA         1219
WP_037581760   1157 NPV---VFLE---AKGYRE--I-QEHLIIK--LPKYSLFE---LENGRRRLLAS -SELQKGNELFLPVDYMTFLYLA         1219
WP_004232481   1189 NPV---SFLE---KKGYHN--V-QEDKLIK--LPKYSLFE---FEGGRRRLLAS ATELQKGNEVLPQYMVNLLYHS         1251
WP_009854540   1184 NPV---EFLE---NKGYHN--I-REDKLIK--LPKYSLFE---FEGGRRRLLAS ASELQKGNEMVLPGYIVELLYHA         1246
WP_012962174   1185 NPV---VFLE---KKGYQN--V-QEDNLIK--LPKYSLFE---FEGGRRRLLAS ASELQKGNEMVLPGYIVELLYHA         1247
WP_039695303   1186 NPV---EFLE---NKGYHN--I-REDKLIK--LPKYSLFE---FEGGRRRLLAS ATELQKGNEVMLPAHLVELLYHA         1248
WP_014334983   1189 NPV---SFLE---KKGYHN--V-QEDKLIK--LPKYSLFE---FEGGRRRLLAS ATELQKGNEVMLPAHLVELLYHA         1251
WP_003099269   1177 DPI---AFLE---KKGYQD--I-QTSSIIK--LPKYSLFE---LENGRKRLLAS --ELQKGNELALPNKYVKFLYLA         1239
AHY15608       1177 DPI---AFLE---KKGYQD--I-QTSSIIK--LPKYSLFE---LENGRKRLLAS -ELQKGNELALPNKYVKFLYLA         1239
ESR09100          9 DPI---AFLE---KKGYQD--I-QTSSIIK--LPKYSLFE---LENGRKRLLAS -KELQKGNELALPNKYVKFLYLA           71
AGM98575       1177 DPI---AFLE---KKGYQD--I-QTSSIIK--LPKYSLFE---LENGRKRLLAS --ELQKGNELALPNKYVKFLYLA         1239
ALF27331       1159 NPV---AFLE---RKGYRN--V-QEENIVK--LPKYSLFE---LENGRKRLLAS ARELQKGNEIVLPNHLGTMLYHA         1221
WP_018372492   1168 EPEr--FLA---QKGFPR--V-EKT--IK--LPKYSLFE---MEKGRRRLLAS SGELQKGNQVLLPEHIRLLSYA          1228
WP_045618028   1189 NPI---AYLE---ECGYKN--I-NPNLIIK--LPKYSLFE---FNNGQRRLLAS SIELQKGNELIVPYHFTALLYHA         1251
WP_045635197   1184 NPI---TFLE---NKGYHN--V-RKENLLC--LPKYSLFE---LENGRKRLLAS AKELQKGNEIVLPVYITTLLYHS         1246
WP_002263549   1159 DPV---AFLE---RKGYRN--V-QEENIIK--LPKYSLFK---LENGRKRLLAS ARELQKGNEIVLPNHLGTLLYHA         1221
WP_002263887   1159 DPV---AFLE---RKGYRN--V-QEENIIK--LPKYSLFK---LENGRKRLLAS ARELQKGNEIVLPNHLGTLLYHA         1221
WP_002264920   1159 DPV---AFLE---RKGYRN--V-QEENIIK--LPKYSLFK---LENGRKRLLAS ARELQKGNEIVLPNHLGTLLYHA         1221
WP_002269043   1159 DPV---AFLE---RKGYRN--V-QEENIIK--LPKYSLFK---LENGRKRLLAS ARELQKGNEIVLPNHLGTLLYHA         1221
WP_002269448   1159 DPV---AFLE---RKGYRN--V-QEENIIK--LPKYSLFK---LENGRKRLLAS ARELQKGNEIVLPNHLGTLLYHA         1221
WP_002271977   1159 DPV---AFLE---RKGYRN--V-QEENIIK--LPKYSLFK---LENGRKRLLAS ARELQKGNEIVLPNHLGTLLYHA         1221
WP_002272766   1159 DPV---AFLE---RKGYRN--V-QEENIIK--LPKYSLFK---LENGRKRLLAS ARELQKGNEIVLPNHLGTLLYHA         1221
WP_002273241   1159 DPV---AFLE---RKGYRN--V-QEENIIK--LPKYSLFK---LENGRKRLLAS ARELQKGNEIVLPNHLGTLLYHA         1221
WP_002275430   1159 DPV---AFLE---RKGYRN--V-QEENIIK--LPKYSLFK---LENGRKRLLAS ARELQKGNEIVLPNHLGTLLYHA         1221
WP_002276448   1159 DPV---AFLE---RKGYRN--V-QEENIIK--LPKYSLFK---LENGRKRLLAS ARELQKGNEIVLPNHLGTLLYHA         1221
WP_002277050   1167 NPV---KFLK---DKGYQQ--I-EKNNFVK--LPKYTLVD---IGNGIKRLWAS SKEVHKGNQLVVSKKSQDLLYHA         1229
WP_002277364   1159 DPV---AFLE---RKGYRN--V-QEENIIK--LPKYSLFK---LENGRKRLLAS ARELQKGNEIVLPNHLGTLLYHA         1221
WP_002279025   1159 DPV---AFLE---RKGYRN--V-QEENIIK--LPKYSLFK---LENGRKRLLAS ARELQKGNEIVLPNHLGTLLYHA         1221
WP_002279859   1159 DPV---AFLE---RKGYRN--V-QEENIIK--LPKYSLFK---LENGRKRLLAS ARELQKGNEIVLPNHLGTLLYHA         1221
WP_002280230   1159 DPV---AFLE---RKGYRN--V-QEENIIK--LPKYSLFK---LENGRKRLLAS ARELQKGNEIVLPNHLGTLLYHA         1221
WP_002281696   1159 DPV---AFLE---RKGYRN--V-QEENIIK--LPKYSLFK---LENGRKRLLAS ARELQKGNEIVLPNHLGTLLYHA         1221
WP_002282247   1167 NPV---KFLK---DKGYQQ--I-EKNNFVK--LPKYTLVD---IGNGIKRLWAS SKEVHKGNQLVVSKKSQDLLYHA         1229
WP_002282906   1159 DPV---AFLE---RKGYRN--V-QEENIIK--LPKYSLFK---LENGRKRLLAS ARELQKGNEIVLPNHLGTLLYHA         1221
WP_002283846   1159 DPV---AFLE---RKGYRN--V-QEENIIK--LPKYSLFK---LENGRKRLLAS ARELQKGNEIVLPNHLGTLLYHA         1221
WP_002287255   1159 DPV---AFLE---RKGYRN--V-QEENIIK--LPKYSLFK---LENGRKRLLAS ARELQKGNEIVLPNHLGTLLYHA         1221
WP_002288990   1159 DPV---AFLE---RKGYRN--V-QEENIIK--LPKYSLFK---LENGRKRLLAS ARELQKGNEIVLPNHLGTLLYHA         1221
WP_002289641   1159 DPV---AFLE---RKGYRN--V-QEENIIK--LPKYSLFK---LENGRKRLLAS ARELQKGNEIVLPNHLGTLLYHA         1221
WP_002290427   1159 DPV---AFLE---RKGYRN--V-QEENIIK--LPKYSLFK---LENGRKRLLAS ARELQKGNEIVLPNHLGTLLYHA         1221
WP_002295753   1159 DPV---AFLE---RKGYRN--V-QEENIIK--LPKYSLFK---LENGRKRLLAS ARELQKGNEIVLPNHLGTLLYHA         1221
WP_002296423   1159 DPV---AFLE---RKGYRN--V-QEENIIK--LPKYSLFK---LENGRKRLLAS ARELQKGNEIVLPNHLGTLLYHA         1221
WP_002304487   1173 DPV---AFLE---RKGYRN--V-QEENIIK--LPKYSLFK---LENGRKRLLAS ARELQKGNEIVLPNHLETLLYHA         1235
WP_002305844   1159 DPI---AFLE---RKGYRN--V-QEENIIK--LPKYSLFK---LENGRKRLLAS ARELQKGNEIVLPNHLGTLLYHA         1221
WP_002307203   1159 DPV---AFLE---RKGYRN--V-QEENIIK--LPKYSLFK---LENGRKRLLAS ARELQKGNEIVLPNHLGTLLYHA         1221
WP_002310390   1159 DPV---AFLE---RKGYRN--V-QEENIIK--LPKYSLFK---LENGRKRLLAS ARELQKGNEIVLPNHLGTLLYHA         1221
WP_002352408   1159 DPV---AFLE---RKGYRN--V-QEENIIK--LPKYSLFK---LENGRKRLLAS ARELQKGNEIVLPNHLGTLLYHA         1221
WP_012997688   1159 DPV---AFLE---RKGYRN--V-QEENIIK--LPKYSLFK---LENGRKRLLAS ARELQKGNEIVLPDHLGTLLYHA         1221
WP_014677909   1159 DPI---AFLE---RKGYRN--V-QEENIIK--LPKYSLFK---LENGRKRLLAS ARELQKGNEIVLPNHLGTLLYHA         1221
WP_019312892   1159 DPV---AFLE---RKGYRN--V-QEENIIK--LPKYSLFK---LENGRKRLLAS ARELQKGNEIVLPNHLGTLLYHA         1221
WP_019313659   1159 DPI---AFLE---RKGYRN--V-QEENIIK--LPKYSLFK---LENGRKRLLAS ARELQKGNEIVLPNHLGTLLYHA         1221
WP_019314093   1159 DPV---AFLE---RKGYRN--V-QEENIIK--LPKYSLFK---LENGRKRLLAS ARELQKGNEIVLPNHLGTLLYHA         1221
WP_019315370   1159 DPV---AFLE---RKGYRN--V-QEENIIK--LPKYSLFK---LENGRKRLLAS ARELQKGNEIVLPNHLGTLLYHA         1221
WP_019803776   1159 DPV---AFLE---RKGYRN--V-QEENIIK--LPKYSLFK---LENGRKRLLAS ARELQKGNEIVLPNHLGTLLYHA         1221
```

| | | | | |
|---|---|---|---|---|
| WP_019805234 | 1159 | DPV----AFLE---RKGYRN--V-QEENIIK--LPKYSLFK---LENGRKRLLAS | ARELQKGNEIVLPNHLGTLLYHA | 1221 |
| WP_024783594 | 1159 | DPV----AFLE---RKGYRN--V-QEENIIK--LPKYSLFK---LENGRKRLLAS | ARELQKGNEIVLPNHLGTLLYHA | 1221 |
| WP_024784288 | 1167 | NPV----KFLK---DKGYQQ--I-EKNNFVK--LPKYTLVD---IGNGIKRLWAS | SKEVHKGNQLVVSKKSQDLLYHA | 1229 |
| WP_024784666 | 1159 | DPV----AFLE---RKGYRN--V-QEENIIK--LPKYSLFK---LENGRKRLLAS | ARELQKGNEIVLPNHLGTLLYHA | 1221 |
| WP_024784894 | 1159 | DPV----AFLE---RKGYRN--V-QEENIIK--LPKYSLFK---LENGRKRLLAS | ARELQKGNEIVLPNHLGTLLYHA | 1221 |
| WP_024786433 | 1167 | NPV----KFLK---DKGYQQ--I-EKNNFVK--LPKYTLVD---IGNGIKRLWAS | SKEVHKGNQLVVSKKSQDLLYHA | 1229 |
| WP_049473442 | 1159 | DPV----AFLE---RKGYRN--V-QEENIIK--LPKYSLFK---LENGRKRLLAS | ARELQKGNEIVLPNHLGTLLYHA | 1221 |
| WP_049474547 | 1159 | DPV----AFLE---RKGYRN--V-QEENIIK--LPKYSLFK---LENGRKRLLAS | ARELQKGNEIVLPNHLGTLLYHA | 1221 |
| EMC03581 | 1152 | DPV----AFLE---RKGYRN--V-QEENIIK--LPKYSLFK---LENGRKRLLAS | ARELQKGNEIVLPNHLGTLLYHA | 1214 |
| WP_000428612 | 1187 | SPI----AFLE---NKGYHN--V-RKENILC--LPKYSLFE---LKNGRRRLLAS | AKELQKGNEIVLPVHLTTLLYHS | 1249 |
| WP_000428613 | 1185 | NPI----TFLE---TFLK---IGNGIKRLWAS--LPKYSLFE---LENGRRRLLAS | AKELQKGNEIVLPVVLTTLLYHS | 1247 |
| WP_049523028 | 1180 | NPV----AFLE---GKGYKN--V-VEENIIN--LPKYSLFE---LENGRRRLLAS | AKELQKGNEMVLPSYIALLYHA | 1242 |
| WP_003107102 | 1146 | DRI----TFLE---KKGYQD--I-QESLLIK--LPKFSLFE---LENGRRRLLAS | --ELQKGNELSLPNKYIQFLYLA | 1208 |
| WP_054279288 | 1179 | NPI----AFLE---SKGYHD--I-QEHLMIT--LPKYSLFE---LENGRRRMLAS | --ELQKGNEMVLPQHLVTFLYRV | 1241 |
| WP_049531101 | 1189 | NPT----AYLE---EYGYKN--I-NPNLIIK--LPKYSLFK---FNDGQRRLLAS | SIELQKGNELILPYHFTTLLYHA | 1251 |
| WP_049538452 | 1189 | NPI----AYLE---ECGYKN--I-NPNLIIK--LPKYSLFE---FNGGQRRLLAS | SIELQKGNELILPYHTALLYHT | 1251 |
| WP_049549711 | 1191 | NPI----AYLE---ECGYKN--I-NPNLIIK--LPKYSLFE---FNGGQRRLLAS | SIELQKGNELILPYHFTALLLYHA | 1253 |
| WP_007896501 | 1183 | DNI----AFLE---KKGYQD--I-QEKLLIK--LPKYSLFE---LENGRRRLLAS | --EFQKGNELALSGKYMKFLYLA | 1245 |
| EFR44625 | 1135 | DPI----AFLE---KKGYQD--I-QELLLIK--LPKYSLFE---LENGRRRLLAS | --EFQKGNELALSGKYMKFLYLA | 1197 |
| WP_002897477 | 1184 | NPI----TFLE---NKGYHN--V-RKENILC--LPKYSLFE---LENGRRRLLAS | AKELQKGNEIVLPVCLTTLLYHS | 1246 |
| WP_002906454 | 1190 | NPV----TYLE---ECGYKN--I-NSNLIIK--LPKYSLFE---FNDGQRRLLAS | SIELQKGNELILPYHLTALLYHA | 1252 |
| WP_009729476 | 1185 | NPI----AFLE---NKGYHN--V-CKENILC--LPKYSLFE---LENGRRRLLAS | AKELQKCNEIVLPVVLTTLLYHS | 1247 |
| CQR24647 | 1175 | NSV----TFLE---TFLE---I-RENTIIK--FPKYSLFE---LESGRRRMLAS | AIELQKGNEMFLPQQFVNLLYHA | 1237 |
| WP_000066813 | 1189 | NPI----TFLE---NKGYRN--V-RKENILC--LPKYSLFE---LESGRRRMLAS | AKELQKGNEIVLPVYLTTLLYHS | 1251 |
| WP_000754323 | 1185 | NPI----TFLE---NKGYKN--I-LEKNIIK--LPKYSLFE---LENGRRRMLAS | AKELQKGNEMLPPHVTLLLYHS | 1247 |
| WP_044674937 | 1178 | NPI----EFLE---HKGYKN--I-LEKNIIK--LPKYSLFE---LENGRRRMLAS | AKELQKGNEMILPPHVTLLLYHS | 1240 |
| WP_044676715 | 1180 | NPI----EFLE---HKGYKN--I-LEKNIIK--LPKYSLFE---LENGRRRMLAS | AKELQKGNEMILPPHVTLLLYHS | 1242 |
| WP_044680361 | 1180 | NPI----EFLE---HKGYKN--I-LEKNIIK--LPKYSLFE---LENGRRRMLAS | AKELQKGNEMILPPHVTLLLYHS | 1242 |
| WP_044681799 | 1178 | NPI----EFLE---HKGYKN--I-LEKNIIK--LPKYSLFE---LENGRRRMLAS | AKELQKGNEMILPPHIVTLLYHS | 1240 |
| WP_049533112 | 1186 | DKR----APLL---GKGYKD--I-K--KIIE--LPKYSLFE---LKDGSRRMLAS | RGEIHKGNELFVPQKFTTLLYHA | 1253 |
| WP_029009095 | 1118 | SETslqAYIA---EQIKSE--VeilN----grilkYQliS---NNGNRLYIAG | --SERHNARQLIVSDEAAKVIWLI | 1181 |
| WP_006506696 | 1150 | EKI----NYIE---eKEGLSD--VrIIK--Dn-IPVNQMIEm----DGGEYLLTS | --EYNARQLVLNEKQCALIADI | 1211 |
| AIT42264 | 1177 | NPI----DFLE---AKGYKE--V-KKDLIIK---S--FKNYTLFE---LENGSRRMIVG | --GELQKGNELALPSKYVNFLYLA | 1239 |
| WP_034440723 | 1150 | QTT----EYLG---KIGFNK--AsIIN---S--FKNYTLFE---LENGSRRMIVG | KGELQKGNQMYLPQNLLEFVVHL | 1217 |
| AKQ21048 | 1177 | NPI----DFLE---AKGYKE--V-KKDLIIK---LPKYSLFE---LEDGSRRMIAS | -GELQKGNELALPSKYVNFLYLA | 1239 |
| WP_004635632 | 1151 | HPT----AYLE---EAGYNN--P-TV--LHE--LPKYQLFE---LEDGSRRMIAS | AKEFQKGNQMVLPLELVELLYHA | 1211 |
| WP_002364836 | 1157 | NPI----LFLE---EKGFLR--P-RV--LMK--LPKYTLYE---FPEGRRRLLAS | AKEAQKGNQMVLPEHLLTLLYHA | 1217 |
| WP_016631044 | 1108 | NPI----LFLE---EKGFLR--P-RV--LMK--LPKYTLYE---FPEGRRRLLAS | AKEAQKGNQMVLPEHLLTLLYHA | 1168 |
| EM575795 | 893 | DPI----GFLS---NKGYSN--V-TKF--IK--LsKYTLYE---LENGRRRMVAS | -KEAQKANSFILPEKLVTLLLYHA | 953 |
| WP_002373311 | 1157 | NPI----LFLE---EKGFLR--P-RV--LMK--LPKYTLYE---FPEGRRRLLAS | AKEAQKGNQMVLPEHLLTLLLYHA | 1217 |
| WP_002378009 | 1157 | NPI----LFLE---EKGFLR--P-RV--LMK--LPKYTLYQ---FPEGRRRLLAS | AKEAQKGNQMVLPEHLLTLLYHA | 1217 |
| WP_002407324 | 1157 | NPI----LFLE---EKGFLR--P-RV--LMK--LPKYTLYE---FPEGRRRLLAS | AKEAQKGNQMVLPEHLLTLLYHA | 1217 |
| WP_002413717 | 1159 | NPI----LFLE---EKGFLR--P-RV--LMK--LPKYTLYE---FPEGRRRLLAS | AKEAQKGNQMVLPEHLLTLLYHA | 1219 |
| WP_010775580 | 1157 | NPI----LFLE---EKGFLR--P-RV--LMK--LPKYTLYE---FPEGRRRLLAS | AKEAQKGNQMVLPEHLLTLLLYHA | 1217 |
| WP_010818269 | 1157 | NPI----LFLE---EKGFLR--P-RV--LMK--LPKYTLYE---FPEGRRRLLAS | AKEAQKGNQMVLPEHLLTLLYHA | 1217 |
| WP_010824395 | 1157 | NPI----LFLE---EKGFLR--P-RV--LMK--LPKYTLYE---FPEGRRRLLAS | AKEAQKGNQMVLPEHLLTLLYHA | 1217 |
| WP_016622645 | 1157 | NPI----LFLE---EKGFLR--P-RV--LMK--LPKYTLYE---FPEGRRRLLAS | AKEAQKGNQMVLPEHLLTLLYHA | 1217 |
| WP_033624816 | 1157 | NPI----LFLE---EKGFLR--P-RV--LMK--LPKYTLYE---FPEGRRRLLAS | AKEAQKGNQMVLPERLLTLLYHA | 1217 |
| WP_033625576 | 1157 | NPI----LFLE---EKGFLR--P-RV--LMK--LPKYTLYE---FPEGRRRLLAS | AKEAQKGNQMVLPEHLLTLLYHA | 1217 |
| WP_033789179 | 1159 | SPV----LFLK---NKGYEQ--A-EIE--MK--LPKYALFE---LENGRKRMVAS | -KEAQKANSFLLPEHLVTLLYHA | 1219 |
| WP_002310644 | 1160 | SPV----LFLK---NKGYEQ--A-EIE--MK--LPKYALFE---LENGRKRMVAS | -KEAQKANSFLLPEHLVTLLYHA | 1220 |
| WP_002312694 | 1159 | SPV----LFLK---NKGYEQ--A-EIE--MK--LPKYALFE---LENGRKRMVAS | -KEAQKANSFLLPEHLVTLLYHA | 1219 |
| WP_002314015 | 1160 | SPV----LFLK---NKGYEQ--A-EIE--MK--LPKYALFE---LENGRKRMVAS | -KEAQKANSFLLPEHLVTLLLYHA | 1220 |

-continued

```
WP_002320716  1160  SPV---LFLK---NKGYEQ--A-EIE--MK--LPKYALFE---LENGRKRMVAS  -KEAQKANSFLLPEHIVTLLYHA  1220
WP_002330729  1159  SPV---LFLK---NKGYEQ--A-EIE--MK--LPKYALFE---LENGRKRMVAS  -KEAQKANSFLLPEHIVTLLYHA  1219
WP_002335161  1160  SPV---LFLK---NKGYEQ--A-EIE--MK--LPKYALFE---LENGRKRMVAS  -KEAQKANSFLLPEHIVTLLYHA  1220
WP_002345439  1160  SPV---LFLK---NKGYEQ--A-EIE--MK--LPKYALFE---LENGRKRMVAS  -KEAQKANSFLLPEHIVTLLYHA  1220
WP_034867970  1150  DPT---TFLK---EKGPPQ--V-TEF--IK--LPKYTLFE---FDNGRRRFLAS  -KESQKGNPFILSDQLVTLLYHA  1210
WP_047937432  1160  SPV---LFLK---NKGYEQ--A-EIE--MK--LPKYALFE---LENGRKRMVAS  -KEAQKANSFLLPEHIVTLLYHA  1220
WP_010720994  1150  DPT---TFLK---DKGFPQ--V-TEF--IK--LPKYTLFE---FDNGRRRFLAS  -KESQKGNPFILSDQLVTLLYHA  1210
WP_010737004  1150  DPT---TFLK---EKGFPQ--V-TEF--IK--LPKYTLFE---FDNGRRRFLAS  -KESQKGNPFILSDQLVTLLYHA  1210
WP_034700478  1150  DPT---TFLK---DKGFPH--V-TEF--IK--LPKYTLFE---FDNGRRRFLAS  -KESQKGNPFILSDQLVTLLYHA  1210
WP_007209903  1148  NPI1---YLS---KKDYHN--pKVEAI---LPKYSLFE---FENGRKRMVAS    -SETQKGNQLIIPGHIMELLYHS  1208
WP_023519017  1144  DPR---EFLK---TKGYEG--V-KQW--LI--LPKYILFE---AQGGYRRMLAS  -QETQKANSLILPENILVTLLYHA 1204
WP_010770040  1155  DPV---SLLE---EKGYAN--P-EV--LIH--LPKYTLYE---LPKYRRLAS   ANEAQKGNQLVLPASIVTLLYHA  1215
WP_048604708  1152  NER---EFLK---NKGYQN--P-QI--CMK--LPKYSLYE---FDDGRRRLLAS AKEAQKGNQMVLPAHLVTFLYHA  1212
WP_010750235  1153  DPI---SFLI---EKGYSN--V-NQF--IK--LPKYTLFE---LANGQRRMLAS -QELQKANSFILPEKLVTLLYHA  1213
AII16583      1216  NPI---DFLE---AKGYKE--V-KKDLIIK---LPKYSLFE---LENGRKRMLAS -GELQKGNELALPSKYVNFLYLA 1278
WP_027073316  1165  TKI---NYIK--eSEGLE--VkIIK---E--ILKNQLIET----NGGLYYTVS  --EIVNARQLIIDFNCTRIIDGI 1225
WP_031589969  1165  IKI---NYIK--qAEDLEE--VgIGK---E--ILKNQLIEk----DGGLYYIVA --EIINAKQLILNESQTKLVCEI 1225
KDA45870      1139  DPT---AYLA---SRGYTNvtNsFIL---PKYSLLEd---PEGRRRYLAS     --KEFQKANELILPQHIVELLYWV 1199
WP_039099354  1171  QKI-spQPTKv--KKQkgtiV-KVVEDFEv-IAPHILNgrfEDNQGELTLGS   ----HNEQELILDKTAVKLLNGA  1241
AKP02966      1173  qNMLE--ENVHKksigIIK--Nn-VPIGQIY----SKKVGLLS            --REIANRQQLILPPEHSALLRIL 1237
KTL---        
WP_010991369  1155  DEK---AFLE---EQGYRQ--P-KV--LAK--LPKYTLYE---CEEGRRRMLAS ANEAQKGNQQVLPNHIVTLLHHA  1215
WP_033838504  1155  DEK---AFLE---EQGYRQ--P-KV--LAK--LPKYTLYE---CEEGRRRMLAS ANEAQKGNQQVLPNHIVTLLHHV  1215
EHN60060      1158  DEK---AFLE---EQGYRQ--P-KV--LAK--LPKYTLYE---CEEGRRRMLAS ANEAQKGNQQVLPNHIVTLLHHV  1218
EFR89594      924   DEK---AFLE---EQGYRQ--P-KV--VLPNHILMTLLYHA              ANEAQKGNQQVLPNHIVTLLHHA  984
WP_038409211  1155  DQK---AFLE---EKGYYS--P-KV--LTK--IPKYTLYE---CENGRRRMLGS ANEAQKGNQMVLPNHILMTLLYHA 1215
EFR95520      774   DQK---AFLE---EKGYYS--P-KV--LTK--IPKYTLYE---CENGRRRMLGS ANEAQKGNQMVLPNHILMTLLYHA 834
WP_003723650  1155  DEE---AFLE---EKGYRH--P-KV--LTK--LPKYTLYE---CEKGRRRMLGS ANEAQKGNQLVLSNHIVSLLYHA  1215
WP_003727705  1155  DEE---AFLE---EKGYRQ--P-KV--LTK--LPKYTLYE---CEKGRRRMLGS ANEAQKGNQLVLSNHIVSLLYHA  1215
WP_003730785  1155  DEE---AFLE---EKGYHQ--P-KV--LTK--LPKYTLYE---CEKGRRRMLGS ANEAQKGNQLVLSNHIVSLLYHA  1215
WP_003733029  1155  DBK---AFLE---EKGYHQ--P-KV--LIK--VPKYTLYE---CKNGRRRMLGS ANEAHKGNQMLLPNHLMALLYHA  1215
WP_003739838  1155  DEK---TFLE---SFLE---P-KV--LTK--LPKYTLYE---CENGRRRMLAS  ANEAQKGNQQVLKGQLITLLHHA  1215
WP_014601172  1155  DEE---AFLE---EKGYHQ--P-KV--LTK--LPKYTLYE---CEKGRRRMLGS ANEAQKGNQLVLSNHIVSLLYHA  1215
WP_023548323  1155  DEK---VFLE---GKGYHQ--P-KV--LTK--LPKYTLYE---CENGRRRMLGS ANEVHKGNQMLLPNHIMTLLYHA  1215
WP_031665337  1155  DBE---AFLE---EKGYRH--P-KV--LTK--LPKYALYE---CENGRRRMLGS ANEAQKGNQLVLSNHIVSLLYHA  1215
WP_031669209  1155  DEE---TFLE---EKGYHQ--P-KV--LIK--VPKYTLYE---CENGRRRMLGS ANEAHKGNQMLLPNHIMALLYHA  1218
WP_033920898  1155  DEK---VFLE---GKGYHQ--P-KV--LTK--LPKYALYE---CENGRRRMLGS ANEVHKGNQMLLPNHIMTLLYHA  1218
AKI42028      1158  DEK---AFLE---EKGYKI--P-KV--LTK--LPKYTLYE---CEKGRRRMLGS ANEAQKGNQLVLSNHIVSLLYHA  1218
AKI50529      1158  DEK---VFLE---GKGYHQ--P-KV--LTK--LPKYTLYE---CEKGRRRMLGS ANEVHKGNQMLLPNHIMTLLYHA  1218
4UN5_B        603   DQE---AFLE---EKGYRH--P-KV--LTK--LPKYTLYE---CEKGRRRMLAS ANEAQKGNQLVLSNHIVSLLYHA  663
EFR83390      1155  DQK---EFLE---EKGYRN--P-KV--ITK--IPKYTLYE---CENGRRRMLGS ANEAHKGNQMLLPNHIMALLYHA  1215
WP_046323366  1193  NPI---DFLE---AKGYKE--V-KKDLIIK---LPKYSLFE---LENGRKRMLAS -GELQKGNELALPSKYVNFLYLA 1255
AKE81011      1247  HRAD---NFNS--TEYLN---YVSEHKKEFEKVLSCVEDFANLYVDE--KNLSKIR-A VAD-SM---DNFSIEE--  1308
CU082355      1155  EQI---EVVE--kEEKLSD--VkIIK---Nn-IPLNQLIEi---DGRQYLLITS --ECVNAMQLVINEEQCKLIADI 1215
WP_033162887  1210  EQL---SYIAspeHEDLID--VrIVK---E---ILKNQLIEi---LPKYSLFE---LENGRKRMLAS -EYTTARQLSLNEQSCKLISEI 1272
AGZ01981      1177  NPI---DFLE---AKGYKE--V-KKDLIIK---LPKYSLFE---LENGRKRMLAS -GELQKGNELALPSKYVNFLYLA 1239
AKA60242      1177  NPI---DFLE---AKGYKE--V-KKDLIIK---LPKYSLFE---LENGRKRMLAS -GELQKGNELALPSKYVNFLYLA 1239
AK540380      1181  NPI---DFLE---AKGYKE--V-KKDLIIK---LPKYSLFE---LENGRKRMLAS -GELQKGNELALPSKYVNFLYLA 1243
WP_010922251  1240  SHYEKLKgSPEDnEQKQL---FVEQHKHYLDEIIEQISEFSKRVILAD---ANLDKVL-S AYN-KH---RDKPIREq-    1305
WP_039695303  1249  HRAD---NFNS--TEYLN---YVSEHKKEFEKVLSCVEDFANLYVDE--KNLSKIR-A VAD-SM---DNFSIEE--    1308
WP_045635197  1247  KNVH---KLDE--PGHLE---YIQKHRNEFKDLLNLVSEFSQKVLAD--ANLEKIK-S LYA-DN---EQADIEI--    1306
5AXW_A        979   GELYRVIgVNNDLLNRIE---VNMIDITYREYLENMDKRPPRIIKTiaSKTQSIK-K LYEvKsk--KHPQIIKtg    1056
WP_099880683  924   SHYEKLKgSPEDnEQKQL---FVEQHKHYLDEIIEQISEFSKRVILAD---ANLDKVL-S AYN-KH---RDKPIREq-   989
WP_010922251  1240  SHYEKLKgSPEDnEQKQL---FVEQHKHYLDEIIEQISEFSKRVILAD---ANLDKVL-S AYN-KH---RDKPIREq-   1305
```

-continued

```
WP_011054416  1240  SHYEKLkgSPEDnEQKQL--FVEQHKHYLDEIIEQISEFSKRVILAD--ANLDKVL-S  AYN-KH---RDKPIREq  1305
WP_011284745  1240  SHYEKLkgSPEDnEQKQL--FVEQHKHYLDEIIEQISEFSKRVILAD--ANLDKVL-S  AYN-KH---RDKPIREq  1305
WP_011285506  1240  SHYEKLkgSPEDnEQKQL--FVEQHKHYLDEIIEQISEFSKRVILAD--ANLDKVL-S  AYN-KH---RDKPIREq  1305
WP_011527619  1240  SHYEKLkgSPEDnEQKQL--FVEQHKHYLDEIIEQISEFSKRVILAD--ANLDKVL-S  AYN-KH---RDKPIREq  1305
WP_012560673  1240  SHYEKLkgSPEDnEQKQL--FVEQHKHYLDEIIEQISEFSKRVILAD--ANLDKVL-S  AYN-KH---RDKPIREq  1305
WP_014407541  1239  SHYEKLkgSPEDnEQKQL--FVEQHKHYLDEIIEQISEFSKRVILAD--ANLDKVL-S  AYN-KH---RDKPIREq  1304
WP_020905136  1240  SHYEKLkgSPEDnEQKQL--FVEQHKHYLDEIIEQISEFSKRVILAD--ANLDKVL-S  AYN-KH---RDKPIREq  1305
WP_023080005  1239  SHYEKLkgSPEDnEQKQL--FVEQHKHYLDEIIEQISEFSKRVILAD--ANLDKVL-S  AYN-KH---RDKPIREq  1304
WP_023610282  1239  SHYEKLkgSPEDnEQKQL--FVEQHKHYLDEIIEQISEFSKRVILAD--ANLDKVL-S  AYN-KH---RDKPIREq  1304
WP_030125963  1240  SHYEKLkgSPEDnEQKQL--FVEQHKHYLDEIIEQISEFSKRVILAD--ANLDKVL-S  AYN-KH---RDKPIREq  1305
WP_030126706  1240  SHYEKLkgSPEDnEQKQL--FVEQHKHYLDEIIEQISEFSKRVILAD--ANLDKVL-S  AYN-KH---RDKPIREq  1305
WP_031488318  1240  SHYEKLkgSPEDnEQKQL--FVEQHKHYLDEIIEQISEFSKRVILAD--ANLDKVL-S  AYN-KH---RDKPIREq  1305
WP_032460140  1240  SHYEKLkgSPEDnEQKQL--FVEQHKHYLDEIIEQISEFSKRVILAD--ANLDKVL-S  AYN-KH---RDKPIREq  1305
WP_032461047  1240  SHYEKLkgSPEDnEQKQL--FVEQHKHYLDEIIEQISEFSKRVILAD--ANLDKVL-S  AYN-KH---RDKPIREq  1305
WP_032462016  1240  SHYEKLkgSPEDnEQKQL--FVEQHKHYLDEIIEQISEFSKRVILAD--ANLDKVL-S  AYN-KH---RDKPIREq  1305
WP_032462936  1240  SHYEKLkgSPEDnEQKQL--FVEQHKHYLDEIIEQISEFSKRVILAD--ANLDKVL-S  AYN-KH---RDKPIREq  1305
WP_032464890  1240  SHYEKLkgSPEDnEQKQL--FVEQHKHYLDEIIEQISEFSKRVILAD--ANLDKVL-S  AYN-KH---RDKPIREq  1305
WP_033888930  1065  SHYEKLkgSPEDnEQKQL--FVEQHKHYLDEIIEQISEFSKRVILAD--ANLDKVL-S  AYN-KH---RDKPIREq  1130
WP_038431314  1240  SHYEKLkgSPEDnEQKQL--FVEQHKHYLDEIIEQISEFSKRVILAD--ANLDKVL-S  AYN-KH---RDKPIREq  1305
WP_038432938  1239  SHYEKLkgSPEDnEQKQL--FVEQHKHYLDEIIEQISEFSKRVILAD--ANLDKVL-S  AYN-KH---RDKPIREq  1304
WP_038434062  1240  SHYEKLkgSPEDnEQKQL--FVEQHKHYLDEIIEQISEFSKRVILAD--ANLDKVL-S  AYN-KH---RDKPIREq  1305
BAQ51233      1151  SHYEKLkgSPEDnEQKQL--FVEQHKHYLDEIIEQISEFSKRVILAD--ANLDKVL-S  AYN-KH---RDKPIREq  1216
KGE60856       415  SHYEKLkgSPEDnEQKQL--FVEQHKHYLDEIIEQISEFSKRVILAD--ANLDKVL-S  AYN-KH---RDKPIREq   480
KGE60162       178  SHYEKLkgSPEDnEQKQL--FVEQHKHYLDEIIEQISEFSKRVILAD--ANLDKVL-S  AYN-KH---RDKPIREq   243
WP_002989955  1240  SHYEKLkgSPEDnEQKQL--FVEQHKHYLDEIIEQISEFSKRVILAD--ANLDKVL-S  AYN-KH---RDKPIREq  1305
WP_003030002  1222  YQIE---KNYE-PEHRE-YVEKHDEFKELLEYISVFSRKYVLAD--NNLTKIE-M     LFS-KN---KDAEVSS-  1281
WP_003065552  1250  QRIN---SENS-TKYLD-YVSAHKKEFEKVLSCVEDFANLYVDVE-KNlLSKIR-A    VAD-SM---DNFSIEE-  1309
WP_001040076  1249  SRYNESkgKPEEiEKKQE--FVNQHVSYFDDILQLINDFSKRVILAD--ANLEKIN-R  LYQ-DNk---ENISVDE  1314
WP_001040078  1241  SRYNESkgKPEEiEKKQE--FVNQHVSYFDDILQLINDFSKRVILAD--ANLEKIN-K  LYQ-DNk---ENISVDE  1306
WP_001040080  1241  SRYNESkgKPEEiEKKQE--FVNQHVSYFDDILQLINDFSKRVILAD--ANLEKIN-K  LYQ-DNk---ENISVDE  1306
WP_001040081  1241  SRYNESkgKPEEiEKKQE--FVNQHVSYFDDILQLINDFSKRVILAD--ANLEKIN-K  LYQ-DNk---ENISVDE  1306
WP_001040085  1241  SRYNESkgKPEEiEKKQE--FVNQHVSYFDDILQLINDFSKRVILAD--ANLEKIN-K  LYQ-DNk---ENISVDE  1306
WP_001040087  1241  SRYNESkgKPEEiEKKQE--FVNQHVSYFDDILQLINDFSKRVILAD--ANLEKIN-K  LYQ-DNk---ENISVDE  1306
WP_001040088  1241  SRYNESkgKPEEiEKKQE--FVNQHVSYFDDILQLINDFSKRVILAD--ANLEKIN-K  LYQ-DNk---ENISVDE  1306
WP_001040089  1241  SRYNESkgKPEEiEKKQE--FVNQHVSYFDDILQLINDFSKRVILAD--ANLEKIN-K  LYQ-DNk---ENISVDE  1306
WP_001040090  1241  SRYNESkgKPEEiEKKQE--FVNQHVSYFDDILQLINDFSKRVILAD--ANLEKIN-K  LYQ-DNk---ENISVDE  1306
WP_001040091  1241  SRYNESkgKPEEiEKKQE--FVNQHVSYFDDILQLINDFSKRVILAD--ANLEKIN-K  LYQ-DNk---ENISVDE  1306
WP_001040092  1241  SRYNESkgKPEEiEKKQE--FVNQHISYFDDILQLINDFSKRVILAD--ANLEKIN-K  LYQ-DNk---ENISVDE  1306
WP_001040094  1241  SRYNESkgKPEEiEQKQE--FVVQHVSYFDDILQLINDFSKRVILAD--ANLEKIN-K  LYS-DNk---DNTPVDE  1306
WP_001040095  1241  SRYNESkgKPEEiEKKQE--FVVQHVSYFDDILQLINDFSNRVILAD--ANLEKIN-K  LYQ-DNk---ENIPVDE  1306
WP_001040096  1241  SRYNESkgKPEEiEQKQE--FVVQHVSYFDDILQLINDFSNRVILAD--ANLEKIN-K  LYQ-DNk---ENIPVDE  1306
WP_001040097  1241  SRYNELkgKPEEiEQKQE--FVVQHVSYFDDILQLINDFSNRVILAD--ANLEKIN-K  LYQ-DNk---ENIPVDE  1306
WP_001040098  1241  SRYNELkgKPEEiEQKQE--FVVQHVSYFDDILQLINDFSNRVILAD--ANLEKIN-K  LYQ-DNk---ENIPVDE  1306
WP_001040099  1241  SRYNESkgKPEEiEQKQE--FVVQHVSYFDDILQLINDFSNRVILAD--ANLEKIN-K  LYQ-DNk---ENIPVDE  1306
WP_001040100  1241  SRYNELkgKPEEiEQKQE--FVVQHVSYFDDILQLINDFSNRVILAD--ANLEKIN-K  LYQ-DNk---ENIPVDE  1306
WP_001040104  1241  SRYNESkgKPEEiEQKQE--FVVQHVSYFDDILQLINDFSNRVILAD--ANLEKIN-K  LYQ-DNk---ENIPVDE  1306
WP_001040105  1241  SRYNELkgKPEEiEQKQE--FVVQHVSYFDDILQLINDFSNRVILAD--ANLEKIN-K  LYQ-DNk---ENIPVDE  1306
WP_001040106  1241  SRYNELkgKPEEiEQKQE--FVVQHVSYFDDILQLINDFSNRVILAD--ANLEKIN-K  LYQ-DNk---ENISVDE  1306
WP_001040107  1241  SRYNELkgKPEEiEQKQE--FVVQHVSYFDDILQLINDFSNRVILAD--ANLEKIN-K  LYQ-DNk---ENISVDE  1306
WP_001040108  1241  SRYNELkgKPEEiEQKQE--FVVQHVSYFDDILQLINDFSNRVILAD--ANLEKIN-K  LYQ-DNk---ENISVDE  1306
WP_001040109  1241  SRYNELkgKPEEiEQKQE--FVVQHVSYFDDILQLINDFSNRVILAD--ANLEKIN-K  LYQ-DNk---ENISVDE  1306
WP_001040110  1241  SRYNELkgKPEEiEQKQE--FVVQHVSYFDDILQLINDFSNRVILAD--ANLEKIN-K  LYQ-DNk---ENISVDE  1306
```

```
                                      -continued

WP_015058523  1241  SRYNESKgKPEEiEKKQE--FVNQHVSYFDDILQLINDFSKRVILAD--ANLEKIN-K  LYS-DNK---DNTPVDE--  1306
WP_017643850  1241  SRYNELKgKPEEiEQKQE--FVVQHVSYFDDILQIINDFSNRVILAD--ANLEKIN-K  LYQ-DNK---ENIPVDE--  1306
WP_017647151  1241  SRYNELKgKPEEiEQKQE--FVVQHVSYFDDILQIINDFSNRVILAD--ANLEKIN-K  LYQ-DNK---ENISVDE--  1306
WP_017648376  1241  SRYNELKgKPEEiEQKQE--FVVQHVSYFDDILQIINDFSNRVILAD--ANLEKIN-K  LYQ-DNK---ENISVDE--  1306
WP_017649527  1241  SRYNESKgKPEEiEKKQE--FVVQHVSYFDDILQLINDFSKRVILAD--ANLEKIN-K  LYQ-DNK---ENISVDE--  1306
WP_017771611  1241  SRYNESKgKPEEiEKKQE--FVVQHVSYFDDILQLINDFSKRVILAD--ANLEKIN-K  LYQ-DNK---ENISVDE--  1306
WP_017771984  1241  SRYNESKgKPEEiEKKQE--FVVQHVSYFDDILQLINDFSKRVILAD--ANLEKIN-K  LYQ-DNK---ENIPVDE--  1306
CFQ25032      1241  SRYNESKgKPEEiEKKQE--FVVQHVSYFDDILQLINDFSKRVILAD--ANLEKIN-K  LYQ-DNK---ENISVDE--  1306
CFV16040      1241  SRYNESKgKPEEiEKKQE--FVVQHVSYFDDILQLINDFSKRVILAD--ANLEKIN-K  LYQ-DNK---ENISVDE--  1306
KLJ37842      1241  SRYNESKgKPEEiEKKQE--FVNQHVSYFDDILQLINDFSKRVILAD--ANLEKIN-K  LYQ-DNK---ENISVDE--  1306
KLJ72361      1241  SRYNESKgKPEEiEKKQE--FVNQHVSYFDDILQLINDFSKRVILAD--ANLEKIN-K  LYQ-DNK---ENISVDE--  1306
KLL20707      1255  SRYNESKgKPEEiEKKQE--FVNQHVSYFDDILQLINDFSKRVILAD--ANLEKIN-K  LYQ-DNK---ENISVDE--  1320
KLL42645      1241  SRYNESKgKPEEiEKKQE--FVNQHVSYFDDILQLINDFSKRVILAD--ANLEKIN-K  LYQ-DNK---ENISVDE--  1306
WP_047207273  1241  SRYNELKgKPEEiEQKQE--FVVQHVSYFDDILQIINDFSNRVILAD--ANLEKIN-K  LYQ-DNK---ENIPVDE--  1306
WP_047209694  1241  SRYNELKgKPEEiEQKQE--FVVQHVSYFDDILQIINDFSNRVILAD--ANLEKIN-K  LYQ-DNK---ENISVDE--  1306
WP_050198062  1241  SRYNESKgKPEEiEKKQE--FVNQHVSYFDDILQLINDFSKRVILAD--ANLEKIN-K  LYQ-DNK---ENISVDE--  1306
WP_050201642  1241  SRYNESKgKPEEiEKKQE--FVNQHVSYFDDILQLINDFSKRVILAD--ANLEKIN-K  IYQ-DNK---ENISVDE--  1306
WP_050204027  1241  SRYNELKgKPEEiEQKQE--FVVQHVSYFDDILQIINDFSNRVILAD--ANLEKIN-K  LYQ-DNK---ENISVDE--  1306
WP_050881965  1241  SRYNESKgKPEEiEKKQE--FVNQHVSYFDDILQLINDFSKRVILAD--ANLEKIN-K  IYQ-DNK---ENISVDE--  1306
WP_050886065  1241  SRYNESKgKPEEiEKKQE--FVNQHVSYFDDILQLINDFSKRVILAD--ANLEKIN-K  LYQ-DNK---ENISVDE--  1306
AHN30376      1241  SRYNESKgKPEEiEKKQE--FVNQHVSYFDDILQLINDFSKRVILAD--ANLEKIN-K  LYS-DNK---DNTPVDE--  1306
EAO78426      1241  SRYNESKgKPEEiEKKQE--FVNQHVSYFDDILQLINDFSKRVILAD--ANLEKIN-K  LYQ-DNK---ENISVDE--  1306
CCW42055      1241  SRYNESKgKPEEiEKKQE--FVNQHVSYFDDILQLINDFSKRVILAD--ANLEKIN-K  LYQ-DNK---ENISVDE--  1306
WP_003041502  1254  KRIN----NPIN-KDHIE--YVKKHRDDFKELLNYVLEFNEKYVGAT-KNGERLK-E    AVA-DF---DSKSNEE--  1313
WP_037593752  1223  YQIE----KNYE-PEHRE--YVEKHKDEFKELLEYISVFSRKYVLAD--NNLTKIE-M   LFS-KN----KDAEVSS--  1282
WP_049516684  1223  YRIE----KDYE-PEHRE--YVEKHKDEFKELLEYISVFSRKYVLAD--NNLTKIE-M   LFS-KN----KDAEVSS--  1282
GAD46167      1254  YQIE----KNYE-PEHRE--YVEKHKDEFKELLEYISVFSRKYVLAD--NNLTKIE-M   LFS-KN----KDAEVSS--  1313
WP_018363470  1249  HRIG----NFNS-AEHLK--YVSEHKKEFEEVLSCVENFANVVVDVE--KNLSKIR-A   AAD-SM---DNFSIEE--  1281
WP_003043819  1254  QNISATTgSNNLg-------YIBQHREEFKEIFEKIIDFSEKYILKN--KVNSNLK-S   SFD-EQfavSDSIL--l   1310
WP_006269658  1222  YRIE----KDYE-PEHRE--YVEKHKDEFKELLEYISVFSRKYVLAD--NNLTKIE-M   LFS-KN----KDAEVSS--  1281
WP_048800889  1242  HRID----NSDN-SEHLK--YITEHKEEFGKLLSYIENFAKSYVDVD--KNLEKIQ-L   AVE-KI----DSFSVKE--  1301
WP_012767106  1246  -HAHKIEsKE--LEHEA--YILDHYNDLYQLLSYIERFASLYVDVE--KNISKVK-E    LFS-NI----ESYSISEi  1308
WP_014612333  1246  -HAHKIEsKE--LEHEA--YILDHYNDLYQLLSYIERFASLYVDVE--KNISKVK-E    LFS-NI----ESYSISEi  1308
WP_015017095  1246  -HAHKIEsKE--LEHEA--YILDHYNDLYQLLSYIERFASLYVDVE--KNISKVK-E    LFS-NI----ESYSISEi  1308
WP_015057649  1246  -HAHKIEsKE--LEHEA--YILDHYNDLYQLLSYIERFASLYVDVE--KNISKVK-E    LFS-NI----ESYSISEi  1308
WP_048327215  1246  -HAHKIEsKE--LEHEA--YILDHYNDLYQLLSYIERFASLYVDVE--KNISKVR-A    LFS-NI----ESYSISEi  1311
WP_049519324  1246  -HAHKIEsKE--LEHEA--YILDHYNDLYQLLSYIERFASLYVDVE--KNISKVK-E    LFS-NI----ESYSISEi  1308
WP_012515931  1220  AHYHELTgsSEDvLRKKY--FVDRHLHYFDDIIQMINDFAERHILAS--SNLEKIN-H   TYH-NN---SDLPVNEr--  1285
WP_021320964  1220  AHYHELTgsSEDvLRKKY--FVERHLHYFDDIIQMINDFAERHILAS--SNLEKIN-H   TYH-NN---SDLPVNEr--  1285
WP_037581760  1220  AHYHELTgsSEDvLRKKY--FVERHLHYFDDIIQMINDFAERHILAS--SNLEKIN-H   TYH-NN---SDLPVNEr--  1285
WP_004232481  1252  QHVN----NSHK-PEHLN--FVERHLHYFDDIPNLIISIARINLLAD--KVVDNL---   -IN-EF---TEYGQED--  1308
WP_009854540  1247  HRAD----NFNS-TEYLN--YVSEHKKEFEKVLSCVEDFANLLYVDE--KNLSKIR-A   VAD-SM---DNFSIEE--  1306
WP_012962174  1248  HRVN----SENN-SEHLK--YVSEHKKEFGEVLSCVENFAKSYVDVE--KNLGKIR-A   VAD-KI---DTFSIED--  1307
WP_039659303  1249  HRAD----NFNS-TEYLN--YVSEHKKEFEKVLSCVEDFANLLYVDE--KNLSKIR-A   VAD-SM---DNFSIEE--  1308
WP_014334983  1252  HRID----SENS-TEHLK--YVSEHKKEFEKVLSCVENFSNLYVDVE--KNLSKVR-A   AAE-SM---TNFSLEE--  1311
WP_003099269  1240  SHYTKFTgKEEDeEKKRS--YVESHLYYFDEIMQIIVEYSNRYILAD--SNLIKIQ-N   LYK-EKg---NFSIEEq-  1305
AHY15608      1240  SHYTKFTgKEEDeEKKRS--YVESHLYYFXEVKSSF---------------------   --------------------  1273
AHY17476      1240  SHYTKFTgKEEDeEKKRS--YVESHLYYFXFX---------------------------  --------------------  1267
ESR09100      72    SHYTKFTgKEEDeEKKRS--YVESHLYYFDEIMQIIVEYSNRYILAD--SNLIKIQ-N   LYK--Ek---DNFSIEEg-  137
AGM98575      1240  QHVN----NSHK-PEHLN--YVKKHDEFKELLDVVSNFSKKNILAE--SNLEKIE-E    LYA-QN---NNKDITE--  1281
ALF27331      1222  KNIH----KVDE-PKHLD---DYD---LEEHRAEFAELLDCIKKFNDMVILAS--SNMSKIE-E  IYQ-KNi---DAPIEE--  1281
WP_018372492  1229  KKVDVLVksKDD---DYD---DYD---LEEHRAEFAELLDCIKKFNDMVILAS--SNMSKIE-E  IYQ-KNi---DAPIEE--  1289
WP_045618028  1252  QRIN----KISE-PIHKQ--YVETHQSEFKELLTAIISLSKKYI-QK--PNVESL--    LQQ-AF---DQSDKIyq  1310
```

```
                      -continued
WP_045635197  1247  KNVH----KLDE-PGHLE--YIQKHRNEFKDLLNLVSEFSQKYVLAD--ANLEKIK-S  LYA-DN---EQADIEI  1306
WP_002263549  1222  KNIH----KVDE-PKHLD--YVDKHKDEFKELLDVVSNFSKKYTLAE--GNLEKIK-E  LYA-QN---NGEDLKE  1281
WP_002263887  1222  KNIH----KVDE-PKHLD--YVDKHKDEFKELLDVVSNFSKKYTLAE--GNLEKIK-E  LYA-QN---NGEDLKE  1281
WP_002264920  1222  KNIH----KVDE-PKHLD--YVDKHKDEFKELLDVVSNFSKKYTLAE--GNLEKIK-E  LYA-QN---NGEDLKE  1281
WP_002269043  1222  KNIH----KVDE-PKHLD--YVDKHKDEFKELLDVVSNFSKKYTLAE--GNLEKIK-E  LYA-QN---NGEDLKE  1281
WP_002269448  1222  KNIH----KVDE-PKHLD--YVDKHKDEFKELLDVVSNFSKKYTLAE--GNLEKIK-E  LYA-QN---NGEDLKE  1281
WP_002271977  1222  KNIH----KVDE-PKHLD--YVDKHKDEFKELLDVVSNFSKKYTLAE--GNLEKIK-E  LYA-QN---NGEDLKE  1281
WP_002272766  1222  KNIH----KVDE-PKHLD--YVDKHKDEFKELLDVVSNFSKKYTLAE--GNLEKIK-E  LYA-QN---NGEDLKE  1281
WP_002273241  1222  KNIH----KVDE-PKHLD--YVDKHKDEFKELLDVVSNFSKKYTLAE--GNLEKIK-E  LYA-QN---NGEDLKE  1281
WP_002275430  1222  KNIH----KVDE-PKHLD--YVDKHKDEFKELLDVVSNFSKKYTLAE--GNLEKIK-E  LYA-QN---NGEDLKE  1281
WP_002276448  1222  KNIH----KVDE-PKHLD--YVDKHKDEFKELLDVVSNFSKKYTLAE--GNLEKIK-E  LYA-QN---NGEDLKE  1281
WP_002277050  1230  HHL-----DN-DYSNE----YVKNHYQQFDILFNEITSFSKKCKLGK--EHIQKIE-E  AYSkER---DSASIEE  1287
WP_002277364  1222  KNIH----KVDE-PKHLD--YVDKHKDEFKELLDVVSNFSKKYTLAE--GNLEKIK-E  LYA-QN---NGEDLKE  1281
WP_002279025  1222  KNIH----KVDE-PKHLD--YVDKHKDEFKELLDVVSNFSKKYTLAE--GNLEKIK-E  LYA-QN---NGEDLKE  1281
WP_002279859  1222  KNIH----KVDE-PKHLD--YVDKHKDEFKELLDVVSNFSKKYTLAE--GNLEKIK-E  LYA-QN---NGEDLKE  1281
WP_002280230  1222  KNIH----KVDE-PKHLD--YVDKHKDEFKELLDVVSNFSKKYTLAE--GNLEKIK-E  LYA-QN---NGEDLKE  1281
WP_002281696  1222  KNIH----KVDE-PKHLD--YVDKHKDEFKELLDVVSNFSKKYTLAE--GNLEKIK-E  LYA-QN---NGEDLKE  1281
WP_002282247  1230  HHL-----DN-DYSNE----YVKNHYQQFDILFNEITSFSKKCKLGK--EHIQKIE-E  AYSkER---DFASIEE  1287
WP_002282906  1222  KNIH----KVDE-PKHLD--YVDKHKDEFKELLDVVSNFSKKYTLAE--GNLEKIK-E  LYA-QN---NGEDLKE  1281
WP_002283846  1222  KNIH----KVDE-PKHLD--YVDKHKDEFKELLDVVSNFSKKYTLAE--GNLEKIK-E  LYA-QN---NGEDLKE  1281
WP_002287255  1222  KNIH----KVDE-PKHLD--YVDKHKDEFKELLDVVSNFSKKYTLAE--GNLEKIK-E  LYA-QN---NGEDLKE  1281
WP_002288990  1222  KNIH----KVDE-PKHLD--YVDKHKDEFKELLDVVSNFSKKYTLAE--GNLEKIK-E  LYA-QN---NGEDLKE  1281
WP_002289641  1222  KNIH----KVDE-PKHLD--YVDKHKDEFKELLDVVSNFSKKYTLAE--GNLEKIK-E  LYA-QN---NGEDLKE  1281
WP_002290427  1222  KNIH----KVDE-PKHLD--YVDKHKDEFKELLDVVSNFSKKYTLAE--GNLEKIK-E  LYA-QN---NGEDLKE  1281
WP_002295753  1222  KNIH----KVDE-PKHLD--YVDKHKDEFKELLDVVSNFSKKYTLAE--GNLEKIK-E  LYA-QN---NGEDLKE  1281
WP_002296423  1222  KNIH----KVDE-PKHLD--YVDKHKDEFKELLDVVSNFSKKYTLAE--GNLEKIK-E  LYA-QN---NGEDLKE  1281
WP_002304487  1236  KNIH----KVDE-PKHLD--YVDKHKDEFKELLDVVSNFSKKYTLAE--GNLEKIK-E  LYA-QN---NGEDLKE  1295
WP_002305844  1222  KNIH----KVDE-PKHLD--YVDKHKDEFKELLDVVSNFSKKYTLAE--GNLEKIK-E  LYA-QN---NGEDLKE  1281
WP_002307203  1222  KNIH----KVDE-PKHLD--YVDKHKDEFKELLDVVSNFSKKYTLAE--GNLEKIK-E  LYA-QN---NGEDLKE  1281
WP_002310390  1222  KNIH----KVDE-PKHLD--YVDKHKDEFKELLDVVSNFSKKYTLAE--GNLEKIK-E  LYA-QN---NGEDLKE  1281
WP_002352408  1222  KNIH----KVDE-PKHLD--YVDKHKDEFKELLDVVSNFSKKYTLAE--GNLEKIK-E  LYA-QN---NGEDLKE  1281
WP_012997688  1222  KNIH----KVDE-PKHLD--YVDKHKDEFKELLDVVSNFSKKYTLAE--GNLEKIK-E  LYA-QN---NGEDLKE  1281
WP_014677909  1222  KNIH----KVDE-PKHLD--YVDKHKDEFKELLDVVSNFSKKYTLAE--GNLEKIK-E  LYA-QN---NGEDLKE  1281
WP_019312892  1222  KNIH----KVDE-PKHLD--YVDKHKDEFKELLDVVSNFSKKYTLAE--GNLEKIK-E  LYA-QN---NGEDLKE  1281
WP_019313659  1222  KNIH----KVDE-PKHLD--YVDKHKDEFKELLDVVSNFSKKYTLAE--GNLEKIK-E  LYA-QN---NGEDLKE  1281
WP_019314093  1222  KNIH----KVDE-PKHLD--YVDKHKDEFKELLDVVSNFSKKYTLAE--GNLEKIK-E  LYA-QN---NGEDLKE  1281
WP_019315370  1222  KNIH----KVDE-PKHLD--YVDKHKDEFKELLDVVSNFSKKYTLAE--GNLEKIK-E  LYA-QN---NGEDLKE  1281
WP_019803776  1222  KNIH----KVDE-PKHLD--YVDKHKDEFKELLDVVSNFSKKYTLAE--GNLEKIK-E  LYA-QN---NGEDLKE  1281
WP_019805234  1222  KNIH----KVDE-PKHLD--YVDKHKDEFKELLDVVSNFSKKYTLAE--GNLEKIK-E  LYA-QN---NGEDLKE  1281
WP_024783594  1222  KNIH----KVDE-PKHLD--YVDKHKDEFKELLDVVSNFSKKYTLAE--GNLEKIK-E  LYA-QN---NGEDLKE  1281
WP_024784288  1230  HHL-----DN-DYSNE----YVKNHYQQFDILFNEITSFSKKCKLGK--EHIQKIE-E  AYSkER---DFASIEE  1287
WP_024784666  1222  KNIH----KVDE-PKHLD--YVDKHKDEFKELLDVVSNFSKKYTLAE--GNLEKIK-E  LYA-QN---NGEDLKE  1281
WP_024784894  1230  HHL-----DN-DYSNE----YVKNHYQQFDILFNEITSFSKKCKLGK--EHIQKIE-E  AYSkER---DSASIEE  1287
WP_049473442  1222  KNIH----KVDE-PKHLD--YVDKHKDEFKELLDVVSNFSKKYTLAE--GNLEKIK-E  LYA-QN---NGEDLKE  1281
WP_049474547  1222  KNIH----KVDE-PKHLD--YVDKHKDEFKELLDVVSNFSKKYTLAE--GNLEKIK-E  LYA-QN---NGEDLKE  1281
EMC03581      1215  SRYTSFSgKEED-EKHRH--FVESHLHYFDEIKDIIADFSRRYILAD--ANLEKIL-T  LYN-EKn---QFSIEEq  1274
WP_000428612  1250  KNIH----RLDE-PEHLE--YIQKHRNEFKDLLNLVSEFSQKYVLAD--ANLEKIK-N  LYA-DN---EQADIEI  1309
WP_000428613  1248  KNVH----KLDE-PEHLE--YIQKHRNEFKDLLNLVSEFSQKYVLAD--ANLEKIQ-N  LYA-DN---EQADIEI  1307
WP_049523028  1243  KRIQ----KKDE-PEHLE--YIKQHHSEFNDLLNFVSEFSQKYVLAE--SNLEKIK-N  LYI-DN---EQTNMEE  1302
WP_003107102  1209  SKRDK---gTQsErME----YISNHKEKFIEIPHYIIRYAEKNVIKP--KVIERLN-D  TFNqKF---NDSDLTEl  1274
WP_054279288  1242  QRIN----KISE-PIHKQ--YVETHQSEFEELLTTIISLSKKYI-QK--PIVESL---  LQQ-AF---EQADKDIyq  1303
WP_049531101  1252                                                              1310
```

| | | | | |
|---|---|---|---|---|
| WP_049538452 | 1252 | QRIN----KISE-PIHKQ--YVEAHQNEFKELLTTIISLSKKYI-QK--PNVESL--- | LQQ-AF---EQAdKDIyq | 1310 |
| WP_049549711 | 1254 | QRIN----KFSE-PIHKQ--YVEAHQNEFKELLTIIISLSKKYI-QK--PNVBSL--- | LHQ-AF---EQAdNDIyq | 1312 |
| WP_007896501 | 1246 | SRYDKLSsKIESeQQKKL--FVEQHLHYFDEILDIVKHATCYIKAE-NNLKKII-S | LYK-KK---EAYSINEq- | 1311 |
| EFR44625 | 1198 | SRYDKLSsKIESeQQKKL--FVEQHLHYFDEILDIVVKHATCYIKAE-NNLKKII-S | LYK-KK---EAYSINEq- | 1263 |
| WP_002897477 | 1247 | KNLH----KLDE-PEHLE--YIQKHREFKDLNLVSEFSQKYILAE--ANLEKIK-D | LYA-DN---EQADIEI-- | 1306 |
| WP_002906454 | 1253 | QRIN----KISE-PIHKQ--YVEAHQNEFKELLTTIISLSKKYI-QK--PNVELL--- | LQQ-AF---DQAdKDIyq | 1311 |
| WP_009729476 | 1248 | KNVH----KLDE-PGHLE--YIQKHRNEFKDLNLVSEFSQKYVLAD--ANLEKIK-N | LYA-DN---EQADIEI-- | 1307 |
| CQR24647 | 1238 | QHAN----KEDS----VI--YLEKHRHELSELPHHIIGVSEKTILKP--KVEMTLN-E | AFE-KHf--EFDEVSE-- | 1295 |
| WP_000066813 | 1252 | KNVH----KLDE-PEHLE--YIQKHRYEFKDLLNLVSEFSQKVLAE--ANLEKIK-N | LYA-DN---EQADIEI-- | 1311 |
| WP_009754323 | 1248 | KNVH----KLDE-PEHLE--YIQKHRYEFKDLNLVSEFSQKYVLAE--ANLEKIK-S | LYV-DN---EQADIEI-- | 1307 |
| WP_044674937 | 1241 | SNIH----KITE-PIHLN--YVNKNKHEFKELLRHISDFSTRYILAQ--DRLSKIE-E | LYD-KN---DGDDISD-- | 1300 |
| WP_044676715 | 1243 | SNIH----KITE-PIHLN--YVNKNKHEFKELLRHISDFSTRYILAQ--DRLSKIE-E | LYD-KN---DGDDISD-- | 1302 |
| WP_044680361 | 1243 | SNIH----KITE-PIHLN--YVNKNKHEFKELLRHISDFSTRYILAQ--DRLSKIE-E | LYD-KN---DGDDISD-- | 1302 |
| WP_044681799 | 1241 | SNIH----KITE-PIHLN--YVNKNKHEFKELLRHISDFSTRYILAQ--DRLSKIE-E | LYD-KN---DGDDISD-- | 1300 |
| WP_049533112 | 1254 | KRIN----NPIN-KDHIE--YVKKHRDDFKELLNYLEFNEKYVGAT--KNGERLK-E | AVA-DF---DSKSNEE-- | 1313 |
| WP_029909005 | 1182 | STKQA---DE-AMFLKyyRLEHLEAVFEEL--IRKQAADYQIFE-KLIKKIEvN | FYS----c---TYNEk- | 1240 |
| WP_006506696 | 1212 | YNAIYKQ-DYDNIDDILMi--------QLYIELTNKMKVLYPAY-rGIAEKFE-S | YVV----i---SKEEk- | 1268 |
| AIT42264 | 1240 | SHYEKLKgSPEDnEQKQL--FVEQHKHYLDEIIEQISEFSKRVILAD--ANLDKVL-S | AYN-KH---RDKPIREq- | 1305 |
| AKQ21048 | 1218 | KHYNE---DE-TSHK--FIVEHKAYFDELLNYIVEFANKYLELE--NSIEBKIK-D | LYH----gKGPDVEEKe | 1276 |
| WP_034440723 | 1240 | SHYEKLKgSPEDnEQKQL--FVEQHKHYLDEIIEQISEFSKRVILAD--ANLDKVL-S | AYN-KH---RDKPIREq- | 1305 |
| WP_004636532 | 1212 | NRYDKVK----fPDSIE--YVHDNLAKFDDLLEYVIDFSNKYINAD--KNVQKIQ-K | IYK-EH---GTEDVEL-- | 1271 |
| WP_002373311 | 1218 | KQCLL----PNQ-SESLA--YVEQHQPEFQEILERVVDFAEVHTLAK--SKVQQIV-K | LFE-AN---QTADVKE-- | 1277 |
| WP_002378009 | 1218 | KQCLL----PNQ-SESLA--YVEQHQPEFQEILERVVDFAEVHTLAK--SKVQQIV-K | LFE-AN---QTADVKE-- | 1277 |
| WP_002407324 | 1218 | KQCLL----PNQ-SESLA--YVEQHQPEFQEILERVVDFAEVHTLAK--SKVQQIV-K | LFE-AN---QTADVKE-- | 1277 |
| WP_002413717 | 1169 | KQCLL----PNQ-SESLA--YVEQHQPEFQEILERVVDFAEVHTLAK--SKVQQIV-K | LFE-QN---QESTVQS-- | 1228 |
| WP_010775580 | 954 | QHYDEIAhKESF----D--YVNDHLSEFREILDQVIDFSNRYTIAA--KNTEKIA-E | LFE-AN---QTADVKE-- | 1013 |
| WP_010818269 | 1218 | KQCLL----PNQ-SESLA--YVEQHQPEFQEILERVVDFAEVHTLAK--SKVQQIV-K | LFE-AN---QTADVKE-- | 1277 |
| WP_002378009 | 1218 | KQCLL----PNQ-SESLA--YVEQHQPEFQEILERVVDFAEVHTLAK--SKVQQIV-K | LFE-AN---QTADVKE-- | 1277 |
| WP_016622645 | 1218 | KQCLL----PNQ-SESLA--YVEQHQPEFQEILERVVDFAEVHTLAK--SKVQQIV-K | LFE-AN---QTADVKE-- | 1277 |
| WP_033624816 | 1218 | KQCLL----PNQ-SESLA--YVEQHQPEFQEILERVVDFAEVHTLAK--SKVQQIV-K | LFE-AN---QTADVKE-- | 1277 |
| WP_033625576 | 1218 | KQCLL----PNQ-SESLA--YVEQHQPEFQEILERVVDFAEVHTLAK--SKVQQIV-K | LFE-TN---QTADVKE-- | 1277 |
| WP_033789179 | 1218 | KQCLL----PNQ-SESLA--YVEQHQPEFQEILERVVDFAEVHTLAK--SKVQQIV-K | LFE-AN---QTADVKE-- | 1277 |
| WP_002310644 | 1220 | KQYDEIShKESF----D--YVNEHHKEFSEVFARVLEFAGKYTLAE--KNIEKLE-K | IYK-EN---QTDDLAK-- | 1279 |
| WP_002312694 | 1221 | KQYDEIShKESF----D--YVNEHHKEFSEVFARVLEFAGKYTLAE--KNIEKLE-K | IYK-EN---QTDDLAK-- | 1280 |
| WP_002314015 | 1221 | KQYDEIShKESF----D--YVNEHHKEFSEVFARVLEFAGKYTLAE--KNIEKLE-K | IYK-EN---QTDDLAK-- | 1280 |
| WP_002320716 | 1221 | KQYDEIShKESF----D--YVNEHHKEFSEVFARVLEFAGKYTLAE--KNIEKLE-K | IYK-EN---QTDDLAK-- | 1280 |
| WP_002330729 | 1220 | KQYDEIShKESF----D--YVNEHHKEFSEVFARVLEFAGKYTLAE--KNIEKLE-K | IYK-EN---QTDDLAK-- | 1279 |
| WP_002335161 | 1221 | KQYDEIShKESF----D--YVNEHHKEFSEVFARVLEFAGKYTLAE--KNIEKLE-K | IYK-EN---QTDDLAK-- | 1280 |
| WP_002345439 | 1221 | KQYDEIShKESF----D--YVNEHHKEFSEVFARVLEFAGKYTLAE--KNIEKLE-K | IYK-EN---QTDDLAK-- | 1280 |
| WP_034867970 | 1211 | QHYDKITyQESF----D--YVNTHLSDFSALLTEVLAFAEKYTLAD--KNIERIQ-E | LYE-EN---KYGETSM-- | 1270 |
| WP_047937432 | 1221 | KQYDEIShKESF----D--YVNTHLSDFSALLTEVLAFAEKYTLAD--KNIEKLE-K | IYK-EN---QTDDLAK-- | 1280 |
| WP_010720994 | 1211 | QHYDKITyQESF----D--YVNTHLSDFSALLTEVLAFAEKYTLAD--KNIERIQ-E | LYE-EN---KYGEISM-- | 1270 |
| WP_010737004 | 1211 | QHYDKITyQESF----D--YVNTHLSDFSALLTEVLAFAEKYTLAD--KNIERIQ-E | LYE-EN---KYGEISM-- | 1270 |
| WP_034700478 | 1211 | QHYDKITyQESF----D--YVNTHLSDFSALLTEVLAFAEKYTLAD--KNIERIQ-E | LYE-EN---KYGEISM-- | 1270 |
| WP_007209003 | 1205 | KKIIN-gKNSD---SVS--YIQNNKEKFREIFEYIVDFSSKYISAD--ANLNKIE-K | LYE-NNfh---KASEqe | 1269 |
| WP_023519017 | 1205 | RHYDEINhKVSF----F--YVNAHKEGENDIFDFISDEGVRYILAP--QHLEKIK-V | AYE-EN---KEVDLKE-- | 1264 |
| WP_010770040 | 1216 | KQVDE-----DS-GKSEE--YVREHRAEFABILNYVQAFSETKILAN--KNLQTIL-K | LYE-EN---KEADIKE-- | 1274 |
| WP_048604708 | 1213 | KHCNE----KP-DSLK--YVTEHQSGFSEIMAHVKDFABKYTLVD--KNLEKIL-S | LYA-KN---MDSEVKE-- | 1270 |
| WP_010750235 | 1214 | NHYDEIAyKDSY----D--YVNEHFSNFQDILDKVIIFABKYTSAP--QKLNQII-A | TYE-KN---QEADRKI-- | 1273 |
| AII16583 | 1279 | SHYEKLKgSPEDnEQKQL--FVEQHKHYLDEIIEQISEFSKRVILAD--ANLDKVL-S | AYN-KH---RDKPIREq- | 1344 |

| | | | | |
|---|---|---|---|---|
| WP_029073316 | 1226 | YKAMKYK-NYSELSQEEIm---------- | ----------NVYDIFVEKLKLYYPTY-kNIATNFE-N | FEN----i----SDEEk- | 1282 |
| WP_031589969 | 1226 | YKAMKYK-NYDNIDSEKIi---------- | ----------DLYRLLINKMELYYPEYrkQLVKKFE-D | LKV----i----SIEEk- | 1283 |
| KDA45870 | 1200 | NAKDG-------EQKLE------------ | ----------DHKAEFKELFDKIMEFADKYVVAP--KNSEKIR-R | LYE-ENq-----DATPme | 1253 |
| WP_039099354 | 1242 | LPLTQ--------SEeLAEQV-------- | ----------YDEILDQVMHYFPLYDTNQFrAKLSAGKaA | DGN-KMv-----QVGQqv | 1306 |
| AKP02966 | 1238 | QIPDE--------DpDQILaf-------- | ----------YDKNILVELLQELITKMKKFYPFY--KNEQEFLaS | FNQ---------ATTSEk- | 1296 |
| WP_010991369 | 1216 | ANCEV--------SD-GKSLD-------- | ----------YIESNREMFAELLAHVSEFAKRYTLAE--ANLNKIN-Q | LFE-QN------KEGDIKA- | 1274 |
| WP_033838504 | 1216 | ANCEV--------SD-GKSLD-------- | ----------YIESNREMFAELLAHVSEFAKRYTLAE--ANLNKIN-Q | LFE-QN------KEGDIKA- | 1274 |
| EHN60060 | 1219 | ANCEV--------SD-GKSLD-------- | ----------YIESNREMFAELLAHVSEFAKRYTLAE--ANLNKIN-Q | LFE-QN------KEGDIKA- | 1277 |
| EFR89594 | 985 | ANCEV--------SD-GKSLD-------- | ----------YIESNREMFAELLAHVSEFAKRYTLAE--ANLNKIN-Q | LFE-QN------KEGDIKA- | 1043 |
| WP_038405211 | 1216 | KNCEA--------ND-GESLA-------- | ----------YIEMHREMFAELLAYISEFAKRYTLAN--DRLEKIN-M | FFE-QN------KKGDIKV- | 1274 |
| EFR95520 | 835 | KNCEA--------ND-GESLA-------- | ----------YIEMHREMFAELLAYISEFAKRYTLAN--DRLEKIN-M | FFE-QN------KKGDIKV- | 893 |
| WP_003723650 | 1216 | KNCEA--------SD-GKSLK-------- | ----------YIEAHRETFSELLAQVSEFATRYTLAD--ANLSKIN-N | LFE-QN------KEGDIKA- | 1274 |
| WP_003727705 | 1216 | KNCEA--------SD-GKSLK-------- | ----------YIEAHRETFSELLAQVSEFATRYTLAD--ANLSKIN-N | LFE-QN------KEGDIKA- | 1274 |
| WP_003730785 | 1216 | KNCEA--------SD-GKSLK-------- | ----------YIEAHRETFSELLAQVSEFATKYTLAD--ANLSKIN-N | LFE-QN------KEGDIKA- | 1274 |
| EKYEA | 1216 | EKYEA--------ID-GESLA-------- | ----------YIEVHRALFDELLAYISEFARKYTLSN--DRLDEIN-M | LYE-RN------KDGDVKS- | 1274 |
| WP_003733029 | 1216 | KNCEA--------SD-GKSLD-------- | ----------YIESNREMFGELLAYISEFARKYTLAD--DRLDEIN-M | LFE-QN------KDNDIKV- | 1274 |
| WP_003739838 | 1216 | KNCEA--------SD-GKSLD-------- | ----------YIESNREMFGELLAYISEFARKYTLAD--DRLDEIN-M | LFE-QN------KDNDIKV- | 1274 |
| WP_014601172 | 1216 | EKREA--------ID-GESLA-------- | ----------YIEAHKAVFGELLAHISEFARKYTLAD--DKLDEIN-M | LYE-RN------KDGDVKS- | 1274 |
| WP_023548323 | 1216 | EKREA--------ID-GESLA-------- | ----------YIEAHRETFSELLAQVSEFATRYTLAD--ANLSKIN-N | LFE-QN------KEGDVKS- | 1274 |
| WP_031665337 | 1216 | KNCEA--------SD-GKSLK-------- | ----------YIEAHRETFSELLAQVSEFATRYTLAN--ANLSKIN-N | LFE-RN------KDGDVKS- | 1274 |
| EKYEA | 1216 | EKYEA--------ID-GESLA-------- | ----------YIEVHRALFDELLAYISEFARKYTLSN--DRLDEIN-M | LYE-RN------KDGDVKS- | 1274 |
| WP_031669209 | 1216 | EKYEA--------ID-GESLA-------- | ----------YIEVHRALFDELLAYISEFARKYTLSN--DRLDEIN-M | LYE-RN------KDGDVKS- | 1274 |
| WP_033920898 | 1216 | EKREA--------ID-GESLA-------- | ----------YIEAHKAVFGELLAHISEFARKYTLAN--DKLDEIN-M | LYE-RN------KDGDVKS- | 1274 |
| AKI42028 | 1219 | EKREA--------ID-GESLA-------- | ----------YIEAHRETFSELLAQVSEFATRYTLAD--ANLSKIN-N | LFE-QN------KEGDIQA- | 1277 |
| AKI50529 | 1219 | EKREA--------ID-GESLA-------- | ----------YIEAHRETFSELLAQVSEFATRYTLAD--ANLSKIN-N | LFE-QN------KEGDIQA- | 1277 |
| EFR83390 | 664 | KNCEA--------SD-GKSLA-------- | ----------YTEAHRETFSELLDSIEQISEFASRYTLAD--ANLEKIN-T | IFE-QN------KEGDIKX- | 722 |
| WP_046323366 | 1216 | KNCEA--------SD-GKSLA-------- | ----------YIESHREMFAELLDSIEQISEFSKRVILAD--ANLDKVL-S | AYN-KH------RDKPIREq- | 1274 |
| AKE81011 | 1256 | SHYEKLKgSPEDnEQKQL---------- | ----------FVEQHKHYLDEIIEQISEFSKRVILAD--ANLDKVL-S | AYN-KH------RDKPIREq- | 1321 |
| CU082355 | 1216 | YNAIYKQ-DFDGIDNMLMi---------- | ----------QLYIQLIDKLKTLYPIy-mGIVEBKPE-K | FVS----i----SKEEk- | 1272 |
| WP_033162887 | 1218 | YAAMLKK-RYEY1DEEEIf---------- | ----------DDYIQLLQKMDTLYPAY-kGIAKRFF-D | FKN----i----DVVEk- | 1274 |
| AGZ01981 | 1273 | SHYEKLKgSPEDnEQKQL---------- | ----------FVEQHKHYLDEIIEQISEFSKRVILAD--ANLDKVL-S | AYN-KH------RDKPIREq- | 1338 |
| AKA60242 | 1240 | SHYEKLKgSPEDnEQKQL---------- | ----------FVEQHKHYLDEIIEQISEFSKRVILAD--ANLDKVL-S | AYN-KH------RDKPIREq- | 1305 |
| AKS40380 | 1240 | SHYEKLKgSPEDnEQKQL---------- | ----------FVEQHKHYLDEIIEQISEFSKRVILAD--ANLDKVL-S | AYN-KH------RDKPIREq- | 1305 |
| 4UN5_B | 1244 | SHYEKLKgSPEDnEQKQL---------- | ----------FVEQHKHYLDEIIEQISEFSKRVILAD--ANLDKVL-S | AYN-KH------RDKPIREq- | 1309 |

| | | | | |
|---|---|---|---|---|
| WP_010922251 | 1306 | -AE---NII | HLFTLTNLGAP-AAFKYPD-[TT]I--DRK--R-YTSTKEVL | DATLIHQSITGLYETRIDLSQL-- | 1365 |
| WP_039695303 | 1309 | ISN---SFI | NLLTLTALGAP-ADFNFLG--EKI--PRK--R-YTSTKECL | NATLIHQSITGLYETRIDLSKL-- | 1369 |
| WP_045635197 | 1307 | LAN---SFI | NLLTFTALGAP-AAFKFFG--KDI--DRK--R-YTTVSEIL | NATLIHQSITGLYETRIDLSKL-- | 1367 |
| 5AXW_A | 990 | -AE---NII | HLFTLTNLGAP-AAFKCPD--TTI--GRN--R-YKSIKEVL | DATLIHQSITGLYETRIDLSQL-- | 1049 |
| WP_009880683 | 1306 | -AE---NII | HLFTLTNLGAP-AAFKYPD--TTI--DRK--R-YKSIKEVL | DATLIHQSITGLYETRIDLSQL-- | 1365 |
| WP_010922251 | 1306 | -AE---NII | HLFTLTNLGAP-AAFKYPD--TTI--DRK--R-YKSIKEVL | DATLIHQSITGLYETRIDLSQL-- | 1365 |
| WP_011054416 | 1306 | -AE---NII | HLFTLTNLGAP-AAFKYPD--TTI--DRK--R-YKSIKEVL | DATLIHQSITGLYETRIDLSQL-- | 1365 |
| WP_011284745 | 1306 | -AE---NII | HLFTLTNLGAP-AAFKYPD--TTI--DRK--R-YKSIKEVL | DATFIHQSITGLYETRIDLSQL-- | 1365 |
| WP_011285506 | 1306 | -AE---NII | HLFTLTNLGAP-AAFKYPD--TTI--DRK--R-YKSIKEVL | DATFIHQSITGLYETRIDLSQL-- | 1365 |
| WP_011527619 | 1306 | -AE---NII | HLFTLTNLGAP-TAFKYPD--TTI--DRK--R-YKSIKEVL | DATLIHQSITGLYETRIDLSQL-- | 1365 |
| WP_012560673 | 1305 | -AE---NII | HLFTLTNLGAP-AAFKCPD--TTI--GRN--R-YTSTKEVL | DATLIHQSITGLYETRIDLSQL-- | 1364 |
| WP_014407541 | 1305 | -AE---NII | HLFTLTNLGAP-AAFKYPD--TTI--DRK--R-YKSIKEVL | DATLIHQSITGLYETRIDLSQL-- | 1364 |
| WP_020905136 | 1306 | -AE---NII | HLFTLTNLGAP-AAFKYPD--TTI--ERN--R-YKSIKEVL | DATLIHQSITGLYEIRIDLSQL-- | 1365 |
| WP_023080005 | 1305 | -AK---NII | HLFTLTNLGAP-AAFKYPD--TTI--ERN--R-YKSIKEVL | DATLIHQSITGLYETRIDLSQL-- | 1364 |
| WP_023610282 | 1305 | -AK---NII | HLFTLTNLGAP-AAFIYPD--TTI--ERN--R-YKSIKEVL | DATLIHQSITGLYETRIDLSQL-- | 1364 |
| WP_030125963 | 1306 | -AE---NII | HLFTLTNLGAP-AAFKYPD--TTI--GRN--R-YKSIKEVL | DATLIHQSITGLYETRIDLSQL-- | 1365 |
| WP_031226706 | 1306 | -AE---NII | HLFTLTNPGAP-AAFKYPD--TTI--DRK--R-YTSTKEVL | DATLIHQSITGLYETRIDLSQL-- | 1365 |
| WP_031488318 | 1306 | -AE---NII | HLFTLTNPGAP-AAFKYPD--TTI--GRN--R-YKSIKEVL | DATLIHQSITGLYETRIDLSQL-- | 1365 |

-continued

| | | | | | |
|---|---|---|---|---|---|
| WP_032460140 | 1306 | -AE---NII | HLFTLTNLGAP-AAFKYFD--TTI--GRN--R-YKSIKEVL | DATLIHQSITGLYETRIDLSQL-- | 1365 |
| WP_032461047 | 1306 | -AE---NII | HLFTLTNLGAP-AAFKYFD--TTI--GRN--R-YKSIKEVL | DATLIHQSITGLYETRIDLSQL-- | 1365 |
| WP_032462016 | 1306 | -AE---NII | HLFTLTNLGAP-AAFKYFD--TTI--DRK--R-YTSTKEVL | DATLIHQSITGLYETRIDLSQL-- | 1365 |
| WP_032462936 | 1306 | -AE---NII | HLFTLTNLGAP-AAFKYFD--TTI--DRK--R-YTSTKEVL | DATLIHQSITGLYETRIDLSQL-- | 1365 |
| WP_032464890 | 1306 | -AE---NII | HLFTLTNLGAP-TAFKYFD--TTI--DRK--R-YTSTKEVL | DATFIHQSITGLYETRIDLSQL-- | 1365 |
| WP_033888930 | 1131 | -AE---NII | HLFTLTNLGAP-AAFKYFD--TTI--DRK--R-YTSTKEVL | DATLIHQSITGLYETRIDLSQL-- | 1190 |
| WP_038431314 | 1306 | -AE---NII | HLFTLTNLGAP-AAFKYFD--TTI--DRK--R-YTSTKEVL | DATLIHQSITGLYETRIDLSQL-- | 1365 |
| WP_038432938 | 1305 | -AK---NII | HLFTLTNLGAP-AAFKYFD--TTI--ERN--R-YKSIKEVL | DATLIHQSITGLYETRIDLSQL-- | 1364 |
| WP_038434062 | 1306 | -AE---NII | HLFTLTNLGAP-AAFKYFD--TTI--GRN--R-YKSIKEVL | DATLIHQSITGLYETRIDLSQL-- | 1365 |
| BAQ51233 | 1217 | -AE---NII | HLFTLTNLGAP-AAFKYFD--TTI--DRK--R-YTSTKEVL | DATLIHQSITGLYETRIDLSQL-- | 1276 |
| KGE60162 | 481 | -AE---NII | HLFTLTNLGAP-AAFKYFD--TTI--DRK--R-YTSTKEVL | DATLIHQSITGLYETRIDLSQL-- | 540 |
| KGE60856 | 244 | -AE---NII | HLFTLTNLGAP-TAFKYFD--TTI--DRK--R-YTSTKEVL | DATFIHQSITGLYETRIDLSQL-- | 303 |
| WP_002989955 | 1306 | -AE---NII | HLFTLTNLGAP-TAFKYFD--TTI--DRK--R-YTSTKEVL | DATFIHQSITGLYETRIDLSQL-- | 1365 |
| WP_003030002 | 1282 | LAK---SFI | SLLTFTAPGAP-AAFNFFG--ENI--DRK--R-YTSVTECL | NATLIHQSITGLYETRIDLSKL-- | 1342 |
| WP_003065552 | 1310 | ISN---SFI | NLLTLTALGAP-ADFNFLG--EKI--PRK--R-YTSTKECL | NATLIHQSITGLYETRIDLSKI-- | 1370 |
| WP_001040076 | 1307 | LAN---NII | NLFTFTSLGAP-AAFKFFD--KIV--DRK--R-YTSTKEVL | NSTLIHQSITGLYETRIDLGKL-- | 1367 |
| WP_001040078 | 1315 | LAN---NII | NLFTFTSLGAP-AAFKFFD--KIV--DRK--R-YTSTKEVL | NSTLIHQSITGLYETRIDLGKL-- | 1375 |
| WP_001040080 | 1307 | LAN---NII | NLFTFTSLGAP-AAFKFFD--KIV--DRK--R-YTSTKEVL | NSTLIHQSITGLYETRIDLGKL-- | 1367 |
| WP_001040081 | 1307 | LAN---NII | NLFTFTSLGAP-AAFKFFD--KIV--DRK--R-YTSTKEVL | NSTLIHQSITGLYETRIDLGKL-- | 1367 |
| WP_001040083 | 1307 | LAN---NII | NLFTFTSLGAP-AAFKFFD--KIV--DRK--R-YTSTKEVL | NSTLIHQSITGLYETRIDLGKL-- | 1367 |
| WP_001040085 | 1307 | LAN---NII | NLFTFTSLGAP-AAFKFFD--KIV--DRK--R-YTSTKEVL | NSTLIHQSITGLYETRIDLGKL-- | 1367 |
| WP_001040087 | 1307 | LAN---NII | NLFTFTSLGAP-AAFKFFD--KIV--DRK--R-YTSTKEVL | NSTLIHQSITGLYETRIDLGKL-- | 1367 |
| WP_001040088 | 1307 | LAN---NII | NLFTFTSLGAP-AAFKFFD--KIV--DRK--R-YTSTKEVL | NSTLIHQSITGLYETRIDLGKL-- | 1367 |
| WP_001040089 | 1307 | LAN---NII | NLFTFTSLGAP-AAFKFFD--KIV--DRK--R-YTSTKEVL | NSTLIHQSITGLYETRIDLGKL-- | 1367 |
| WP_001040090 | 1307 | LAN---NII | NLFTFTSLGAP-AAFKFFD--KIV--DRK--R-YTSTKEVL | NSTLIHQSITGLYETRIDLGKL-- | 1367 |
| WP_001040091 | 1307 | LAN---NII | NLFTFTSLGAP-AAFKFFD--KIV--DRK--R-YTSTKEVL | NSTLIHQSITGLYETRIDLGKL-- | 1367 |
| WP_001040092 | 1307 | LAK---NII | NLFTFTSLGAP-AAFKFFD--KSV--DRK--R-YTSTKEVL | DSTLIHQSITGLYETRIDLGKL-- | 1367 |
| WP_001040094 | 1307 | LAN---NII | NLFTFTSLGAP-AAFKFFD--KIV--DRK--R-YTSTKEVL | NSTLIHQFITGLYETRIDLGKL-- | 1367 |
| WP_001040095 | 1307 | LAN---NII | NLFTFTSLGAP-AAFKFFD--KIV--DRK--R-YTSTKEVL | NSTLIHQSITGLYETRIDLGKL-- | 1367 |
| WP_001040096 | 1307 | LAN---NII | NLFTFTSLGAP-AAFKFFD--KIV--DRK--R-YTSTKEVL | NSTLIHKSITGLYETRIDLGKL-- | 1367 |
| WP_001040097 | 1307 | LAN---NII | NLFTFTSLGAP-AAFKFFD--KIV--DRK--R-YTSTKEVL | NSTLIHQSITGLYETRIDLGKL-- | 1367 |
| WP_001040098 | 1307 | LAN---NII | NLFTFTSLGAP-AAFKFFD--KIV--DRK--R-YTSTKEVL | NSTLIHQSITGLYETRIDLGKL-- | 1367 |
| WP_001040099 | 1307 | LAN---NII | NLFTFTSLGAP-AAFKFFD--KIV--DRK--R-YTSTKEVL | NSTLIHQSITGLYETRIDLGKL-- | 1367 |
| WP_001040100 | 1307 | LAN---NII | NLFTFTSLGAP-AAFKFFD--KIV--DRK--R-YTSTKEVL | NSTLIHQSITGLYETRIDLGKL-- | 1367 |
| WP_001040104 | 1307 | LAN---NII | NLFTFTSLGAP-AAFKFFD--KIV--DRK--R-YTSTKEVL | NSTLIHQSITGLYETRIDLGKL-- | 1367 |
| WP_001040105 | 1307 | LAN---NII | NLFTFTSLGAP-AAFKFFD--KIV--DRK--R-YTSTKEVL | NSTLIHQSITGLYETRIDLGKL-- | 1367 |
| WP_001040106 | 1307 | LAN---NII | NLFTFTSLGAP-AAFKFFD--KIV--DRK--R-YTSTKEVL | NSTLIHQSITGLYETRIDLGKL-- | 1367 |
| WP_001040107 | 1307 | LAN---NII | NLFTFTSLGAP-AAFKFFD--KIV--DRK--R-YTSTKEVL | NSTLIHQSITGLYETRIDLGKL-- | 1367 |
| WP_001040108 | 1307 | LAN---NII | NLFTFTSLGAP-AAFKFFD--KIV--DRK--R-YTSTKEVL | DSTLIHQSITGLYETRIDLGKL-- | 1367 |
| WP_001040109 | 1307 | LAN---NII | NLFTFTSLGAP-AAFKFFD--KIV--DRK--R-YTSTKEVL | NSTLIHQSITGLYETRIDLGKL-- | 1367 |
| WP_001040110 | 1307 | LAN---NII | NLFTFTSLGAP-AAFKFFD--KIV--DRK--R-YTSTKEVL | NSTLIHQSITGLYETRIDLGKL-- | 1367 |
| WP_015058523 | 1307 | LAK---NII | NLFTFTSLGAP-AAFKFFD--KSV--DRK--R-YTSTKEVL | NSTLIHQSITGLYETRIDLGKL-- | 1367 |
| WP_017643650 | 1307 | LAN---NII | NLFTFTSLGAP-AAFKFFD--KIV--DRK--R-YTSTKEVL | NSTLIHQSITGLYETRIDLGKL-- | 1367 |
| WP_017647151 | 1307 | LAN---NII | NLFTFTSLGAP-AAFKFFD--KIV--DRK--R-YTSTKEVL | NSTLIHQSITGLYETRIDLGKL-- | 1367 |
| WP_017648376 | 1307 | LAN---NII | NLFTFTSLGAP-AAFKFFD--KIV--DRK--R-YTSTKEVL | NSTLIHQSITGLYETRIDLGKL-- | 1367 |
| WP_017649527 | 1307 | LAN---NII | NLFTFTSLGAP-AAFKFFD--KIV--DRK--R-YTSTKEVL | NSTLIHQSITGLYETRIDLGKL-- | 1367 |
| WP_017771611 | 1307 | LAN---NII | NLFTFTSLGAP-AAFKFFD--KIV--DRK--R-YTSTKEVL | NSTLIHQSITGLYETRIDLGKL-- | 1367 |
| WP_017771984 | 1307 | LAN---NII | NLFTFTSLGAP-AAFKFFD--KIV--DRK--R-YTSTKEVL | NSTLIHQSITGLYETRIDLGKL-- | 1367 |
| CFQ25032 | 1307 | LAN---NII | NLFTFTSLGAP-AAFKFFD--KIV--DRK--R-YTSTKEVL | NSTLIHQSITGLYETRIDLGKL-- | 1367 |
| CFV16040 | 1307 | LAN---NII | NLFTFTSLGAP-AAFKFFD--KIV--DRK--R-YTSTKEVL | NSTLIHQSITGLYETRIDLGKL-- | 1367 |
| KLJ37842 | 1307 | LAN---NII | NLFTFTSLGAP-AAFKFFD--KIV--DRK--R-YTSTKEVL | NSTLIHQSITGLYETRIDLGKL-- | 1367 |
| KLJ72361 | 1307 | LAN---NII | NLFTFTSLGAP-AAFKFFD--KIV--DRK--R-YTSTKEVL | NSTLIHQSITGLYETRIDLGKL-- | 1367 |
| KLL20707 | 1321 | LAN---NII | NLFTFTSLGAP-AAFKFFD--KIV--DRK--R-YTSTKEVL | NSTLIHQSITGLYETRIDLGKL-- | 1381 |

| | | | | | |
|---|---|---|---|---|---|
| KLL42645 | 1307 | LAN---NII | NLFTFTSLGAP-AAFKFFD--KIV-DRK--R-YTSTKEVL | NSTLIHQSITGLYETRIDLGKL- | 1367 |
| WP_047207273 | 1307 | LAN---NII | NLFTFTSLGAP-AAFKFFD--KIV-DRK--R-YTSTKEVL | NSTLIHQSITGLYETRIDLGKL- | 1367 |
| WP_047209694 | 1307 | LAN---NII | NLFTFTSLGAP-AAFKFFD--KIV-DRK--R-YTSTKEVL | NSTLIHKSITGLYETRIDLGKL- | 1367 |
| WP_050198062 | 1307 | LAN---NII | NLFTFTSLGAP-AAFKFFD--KIV-DRK--R-YTSTKEVL | NSTLIHQSITGLYETRIDLGKL- | 1367 |
| WP_050201642 | 1307 | LAN---NII | NLFTFTSLGAP-AAFKFFD--KIV-DRK--R-YTSTKEVL | NSTLIHQSITGLYETRIDLGKL- | 1367 |
| WP_050204027 | 1307 | LAN---NII | NLFTFTSLGAP-AAFKFFD--KII-DRK--R-YTSTKEVL | NSTLIHQSITGLYETRIDLGKL- | 1367 |
| WP_050881965 | 1307 | LAN---NII | NLFTFTSLGAP-AAFKFFD--KIV-DRK--R-YTSTKEVL | NSTLIHQSITGLYETRIDLGKL- | 1367 |
| WP_050886065 | 1307 | LAN---NII | NLFTFTSLGAP-AAFKFFD--KSV-DRK--R-YTSTKEVL | DSTLIHQSITGLYETRIDLGKL- | 1367 |
| AHN30376 | 1307 | LAK---NII | NLFTFTSLGAP-AAFKFFD--KIV-DRK--R-YTSTKEVL | NSTLIHQSITGLYETRIDLGKL- | 1367 |
| EA078426 | 1307 | LAN---NII | NLFTFTSLGAP-AAFKFFD--KIV-DRK--R-YTSTKEVL | NSTLIHQSITGLYETRIDLGKL- | 1367 |
| CCW42055 | 1307 | LAN---NII | NLFTFTSLGAP-AAFKFFD--KIV-DRK--R-YTSTKEVL | NSTLIHQSITGLYETRIDLSKL- | 1367 |
| WP_003041502 | 1314 | ICT---SFL | GLPELTSLGSA-SDFEFLG--VKI-PRY-RQYTPSSLLK | DSTLIHQSITGLYETRIDLSKL- | 1383 |
| WP_037593752 | 1283 | LAK---SFI | SLLTFTAFGAP-AAFNFFG--ENI-DRK--R-YTSVTECL | NATLIHQSITGLYETRIDLSKL- | 1343 |
| WP_037595684 | 1283 | LAK---SFI | SLLTFTAFGAP-AAFNFFG--ENI-DRK--R-YTSVTECL | NATLIHQSITGLYETRIDLSKL- | 1343 |
| GAD46167 | 1282 | LAK---SFI | SLLTFTAFGAP-AAFNFFG--ENI-DRK--R-YTSVTECL | NATLIHQSITGLYETRIDLSKL- | 1342 |
| WP_018363470 | 1314 | ISD---SFI | NLLTFTASGAP-ADFNFLG--EKI-PRK--R-YNSTKECL | NATLIHQSITGLYETRIDLSQL- | 1374 |
| WP_003043819 | 1311 | -SN---SFV | SLLKYTSPGAS-GGFTFLD--LDVkqGRL--R-YQTVTEVL | DATLIYQSITGLYETRTDLSQL- | 1372 |
| WP_006269658 | 1282 | LAK---SFI | SLLTFTAPGAP-AAFNFFG--ENI-DRK--R-YTSVTECL | NATLIHQSITGLYETRIDLSKL- | 1342 |
| WP_048800889 | 1302 | ISN---SFI | HLLTLTAIGAP-ADFNFLG--EKI-PRK--R-YTSVTECL | NATLIHQSITGLYETQTDLSKL- | 1362 |
| WP_012767106 | 1309 | -CS---SVI | NLLTLTASGAP-ADFKFLG--TTI-PRK--R-YGSPQSIL | SSTLIHQSITGLYETRIDLSQL- | 1368 |
| WP_014612333 | 1309 | -CS---SVI | NLLTLTASGAP-ADFKFLG--TTI-PRK--R-YGSPQSIL | SSTLIHQSITGLYETRIDLSQL- | 1368 |
| WP_015017095 | 1309 | -CS---SVI | NLLTLTASGAP-ADFKFLG--TTI-PRK--R-YGSPQSIL | SSTLIHQSITGLYETRIDLSQL- | 1368 |
| WP_015057649 | 1309 | -CS---SVI | NLLTLTASGAP-ADFKFLG--TTI-PRK--R-YGSPQSIL | SSTLIHQSITGLYETRIDLSQL- | 1368 |
| WP_048327215 | 1309 | -CS---SVI | NLLTLTASGAP-ADFKFLG--TTI-PRK--R-YGSPQSIL | SSTLIHQSITGLYETRIDLSQL- | 1368 |
| WP_049519324 | 1286 | -AE---NII | NVFTFVALGAP-AAFKFLG--ATI-DRK--R-YTSTKEVL | NATLIHQSVTGLYETRIDLSQL- | 1345 |
| WP_012515931 | 1286 | -AE---SFI | NVFTFVALGAP-AAFKFLG--ATI-DRK--R-YTSTKEVL | NATLIHQSVTGLYETRIDLSQL- | 1345 |
| WP_021320964 | 1286 | -AE---SFI | NVFTFVALGAP-AAFKFLG--ATI-DRK--R-YTSTKEVL | NATLIHQSVTGLYETRIDLSQL- | 1345 |
| WP_037581760 | 1309 | ISSlseSFI | NLLKFISFGAP-GAFKFLK--LDV-KQSnlR-YKSSTEAL | SATLIHQSVTGLYETRIDLSKL- | 1374 |
| WP_004232481 | 1307 | ISN---SFI | NLLTLTALGAP-ADFNFLG--EKI-PRK--R-YTSTKECL | TATLIHQSITGLYETRIDLSKL- | 1367 |
| WP_009854540 | 1308 | ISI---SFV | NLLTLTALGAP-ADFNFLG--EKI-PRK--R-YTSTKECL | NATLIHQSITGLYETRIDLSKL- | 1368 |
| WP_012961174 | 1309 | ISN---SFI | NLLTLTALGAP-ADFNFLG--EKI-PRK--R-YTSTKECL | NATLIHQSITGLYETRIDLSKL- | 1369 |
| WP_039695303 | 1312 | ISA---SFI | NLLTLTALGAP-ADFNFLG--EKI-PRK--R-YTSTKECL | SATLIHQSVTGLYETRIDLSKL- | 1372 |
| WP_014334983 | 1306 | -AI---NML | NLFTFTDLGAP-SAFKFFN--GDI-DRK--R-YSSTNEII | NSTLIHQSITGLYETRIDLNKL- | 1365 |
| WP_003099269 | | | | | |
| AHY17476 | 138 | -AI---NML | NLFTFTDLGAP-SAFKFFNg--DI-DRK--R-YSSTNEII | NSTLIYQSPTGLYETRIDLSKL- | 197 |
| ESR09100 | | | | | |
| AGM98575 | 1282 | LAS---SFI | NLLTFTAIGAP-AAFKFFD--QII-PRK--R-YTSTTEIL | NATLIHQSITGLVTGLYETRIDLSRL- | 1342 |
| ALF27331 | 1290 | VAR---SFV | -LLNFTMMGAA-TDFKFPG--VEI-SQSnvR-YPSSTTECL | KSTLIHQSVTGLYETRIDLSKL- | 1350 |
| WP_018372492 | 1311 | LSE---SFI | SLLKLISPGAP-GTFKFLG--VEI-SQSnvR-YQSVSSCF | NATLIHQSITGLYETRIDLSKL- | 1373 |
| WP_045618028 | 1307 | LAN---SFI | NLLTFTAIGAP-AAFKFPG--KDI-DRK--R-YTTVSEIL | NATLIHQSITGLYETWIDLSKL- | 1367 |
| WP_045635197 | 1282 | LAS---SFI | NLLTFTAIGAP-ATFKFFD--KNI-DRK--R-YTSTTEIL | NATLIHQSITGLYETRIDLNKL- | 1342 |
| WP_002263549 | 1282 | LAS---SFI | NLLTFTAIGAP-ATFKFFD--KNI-DRK--R-YTSTTEIL | NATLIHQSITGLYETRIDLSKL- | 1342 |
| WP_002263887 | 1282 | LAS---SFI | NLLTFTAIGAP-ATFKFFD--KNI-DRK--R-YTSTTEIL | NATLIHQSITGLYETRIDLSKL- | 1342 |
| WP_002264920 | 1282 | LAS---SFI | NLLTFTAIGAP-ATFKFFD--KNI-DRK--R-YTSTTEIL | NATLIHQSITGLYETRIDLSKL- | 1342 |
| WP_002269043 | 1282 | LAS---SFI | NLLTFTAIGAP-ATFKFFD--KNI-DRK--R-YTSTTEIL | NATLIHQSITGLYETRIDLSKL- | 1342 |
| WP_002269448 | 1282 | LAS---SFI | NLLTFTAIGAP-ATFKFFD--KNI-DRK--R-YTSTTEIL | NATLIHQSITGLYETRIDLSKL- | 1342 |
| WP_002271977 | 1282 | LAS---SFI | NLLTFTAIGAP-ATFKFFD--KNI-DRK--R-YTSTTEIL | NATLIHQSITGLYETRIDLSKL- | 1342 |
| WP_002272766 | 1282 | LAS---SFI | NLLTFTAIGAP-ATFKFFD--KNI-DRK--R-YTSTTEIL | NATLIHQSITGLYETRIDLSKL- | 1342 |
| WP_002273241 | 1282 | LAS---SFI | NLLTFTAIGAP-AAFKFFD--KNI-DRK--R-YTSTTEIL | NATLIHQSITGLYETRIDLSKL- | 1342 |
| WP_002275430 | 1282 | LSS---SFI | NLLTFTAIGAP-ATFKFFD--KNI-DRK--R-YTSTTEIL | NATLIHQSITGLYETRIDLNKL- | 1342 |
| WP_002276448 | 1282 | LAS---SFI | NLLTFTAIGAP-ATFKFFD--KNI-DRK--R-YTSTTEIL | NATLIHQSITGLYETRIDLSKL- | 1342 |
| WP_002277050 | 1288 | LAD---GFI | KLLGFTQLGAT-SPFSFLG--IKL-NQK--Q-YTGKKDYL | EATLIHQSITGLYETRIDLNKL- | 1352 |

```
WP_002273364   1282  LAS---SFI  NLLTFTAIGAP-ATFKFFD--KNI--DRK--R-YTSTTEIL  NATLIHQSITGLYETRIDLSKL--  1342
WP_002279025   1282  LAS---SFI  NLLTFTAIGAP-ATFKFFD--KNI--DRK--R-YTSTTEIL  NATLIHQSITGLYETRIDLSKL--  1342
WP_002279859   1282  LAS---SFI  NLLTFTAIGAP-ATFKFFD--KNI--DRK--R-YTSTTEIL  NATLIHQSITGLYETRIDLSKL--  1342
WP_002280230   1282  LAS---SFI  NLLTFTAIGAP-ATFKFFD--KNI--DRK--R-YTSTTEIL  NATLIHQSITGLYETRIDLSKL--  1342
WP_002281696   1282  LSS---SFI  NLLTFTAIGAP-AAFKFFD--KNI--DRK--R-YTSTTEIL  NATLIHQSITGLYETRIDLSKL--  1342
WP_002282247   1288  LAD---GFI  KLLGFTQLGAT-SPFSFLG--IKL--NQK--Q-YTGKKDYL  EATLIHQSITGLYETRIDLSKL--  1352
WP_002282906   1282  LAS---SFI  NLLTFTAIGAP-ATFKFFD--KNI--DRK--R-YTSTTEIL  NATLIHQSITGLYETRIDLSKL--  1342
WP_002283846   1282  LAS---SFI  NLLTFTAIGAP-ATFKFFD--KNI--DRK--R-YTSTTEIL  NATLIHQSITGLYETRIDLSKL--  1342
WP_002287255   1282  LAS---SFI  NLLTFTAIGAP-ATFKFFD--KNI--DRK--R-YTSTTEIL  NATLIHQSITGLYETRIDLSKL--  1342
WP_002288990   1282  LAS---SFI  NLLTFTAIGAP-AAFKFFD--KNI--DRK--R-YTSTTEIL  NATLIHQSITGLYETRIDLSKL--  1342
WP_002289641   1282  LAS---SFI  NLLTFTAIGAP-ATFKFFD--KNI--DRK--R-YTSTTEIL  NATLIHQSITGLYETRIDLSKL--  1342
WP_002290427   1282  LAS---SFI  NLLTFTAIGAP-ATFKFFD--KNI--DRK--R-YTSTTEIL  NATLIHQSITGLYETRIDLSKL--  1342
WP_002295753   1282  LAS---SFI  NLLTFTAIGAP-AAFKFFD--KNI--DRK--R-YTSTTEIL  NATLIHQSITGLYETRIDLSKL--  1342
WP_002296423   1282  LAS---SFI  NLLTFTAIGAP-ATFKFFD--KNI--DRK--R-YTSTTEIL  NATLIHQSITGLYETRIDLNKL--  1342
WP_002304487   1296  LAS---SFI  NLLTFTAIGAP-AAFKFFD--KNI--DRK--R-YTSTTEIL  NATLIHQSITGLYETRIDLSKL--  1356
WP_002305844   1282  LAS---SFI  NLLTFTAIGAP-ATFKFFD--KNI--DRK--R-YTSTTEIL  NATLIHQSITGLYETRIDLSKL--  1342
WP_002307203   1282  LAS---SFI  NLLTFTAIGAP-ATFKFFD--KNI--DRK--R-YTSTTEIL  NATLIHQSITGLYETRIDLSKL--  1342
WP_002310390   1282  LAS---SFI  NLLTFTAIGAP-ATFKFFD--KNI--DRK--R-YTSTTEIL  NATLIHQSITGLYETRIDLSKL--  1342
WP_002352408   1282  LAS---SFI  NLLTFTAIGAP-ATFKFFD--KNI--DRK--R-YTSTTEIL  NATLIHQSITGLYETRIDLSKL--  1342
WP_012997688   1282  LAS---SFI  NLLTFTAIGAP-ATFKFFD--KNI--DRK--R-YTSTTEIL  NATLIHQSITGLYETRIDLSKL--  1342
WP_014677909   1282  LAS---SFI  NLLTFTAIGAP-ATFKFFD--KNI--DRK--R-YTSTTEIL  NATLIHQSITGLYETRIDLSKL--  1342
WP_019312892   1282  LAS---SFI  NLLTFTAIGAP-ATFKFFD--KNI--DRK--R-YTSTTEIL  NATLIHQSITGLYETRIDLNKL--  1342
WP_019313659   1282  LAS---SFI  NLLTFTAIGAP-ATFKFFD--KNI--DRK--R-YTSTTEIL  NATLIHQSITGLYETRIDLSKL--  1342
WP_019314093   1282  LAS---SFI  NLLTFTAIGAP-ATFKFFD--KNI--DRK--R-YTSTTEIL  NATLIHQSITGLYETRIDLSKL--  1342
WP_019315370   1282  LSS---SFI  NLLTFTAIGAP-AAFKFFD--KNI--DRK--R-YTSTTEIL  NATLIHQSITGLYETRIDLSKL--  1342
WP_019803776   1282  LAS---SFI  NLLTFTAIGAP-ATFKFFD--KNI--DRK--R-YTSTTEIL  NATLIHQSITGLYETRIDLNKL--  1342
WP_019805234   1282  LAS---SFI  NLLTFTAIGAP-ATFKFFD--KNI--DRK--R-YTSTTEIL  NATLIHQSITGLYETRIDLNKL--  1342
WP_024783594   1282  LAS---SFI  NLLTFTAIGAP-ATFKFFD--KNI--DRK--R-YTSTTEIL  NATLIHQSITGLYETRIDLSKL--  1342
WP_024784288   1288  LAD---GFI  KLLGFTQLGAT-SPFSFLG--IKL--NQK--Q-YTGKKDYL  EATLIHQSITGLYETRIDLSKL--  1352
WP_024784666   1282  LAS---SFI  NLLTFTAIGAP-ATFKFFD--KNI--DRK--R-YTSTTEIL  NATLIHQSITGLYETRIDLSKL--  1342
WP_024784894   1282  LAS---SFI  NLLTFTAIGAP-ATFKFFD--KNI--DRK--R-YTSTTEIL  NATLIHQSITGLYETRIDLSKL--  1342
WP_024786433   1288  LAD---GFI  KLLGFTQLGAT-SPFSFLG--IKL--NQK--Q-YTGKKDYL  EATLIHQSITGLYETRIDLSKL--  1352
WP_049473442   1282  LAS---SFI  NLLTFTAIGAP-ATFKFFD--KNI--DRK--R-YTSTTEIL  NATLIHQSITGLYETRIDLSKL--  1342
WP_049474547   1282  LAS---SFI  NLLTFTAIGAP-ATFKFFD--KNI--DRK--R-YTSTTEIL  KATLIHQSITGLYETRIDLSKL--  1342
EMC03581       1275  LAS---SFI  NLLTFTAIGAP-ATFKFFD--KNI--DRK--R-YTSTTEIL  NATLIHQSITGLYETRIDLSKL--  1335
WP_000428612   1310  LAN---SFI  NLLTFTALGAP-AAFKFFG--KDV--DRK--R-YTTVSEIL  NATLIHQSVTGLYETRIDLSKL--  1370
WP_000428613   1308  LAN---SFI  NLLTFTALGAP-AAFKFFG--KDI--DRK--R-YTTVSEIL  NATLIHQSITGLYETRIDLSKL--  1368
WP_049523028   1303  IAN---SFI  NLLTFTAPGAP-AVFKFFG--KDI--ERK--R-YSTVTEIL  KATLIHQSLTGLYETRIDLSKL--  1363
WP_003107102   1275  -AT---NML  NLPFTFTGLGAP-ATLKFFN--VDI--DRK--R-YRSTKECL  NSTLIRQSITGLYETRIDLSKI--  1334
WP_054279288   1304  -SI---SFL  NLPFKFTSFGAP-EKFTFLN--SEIkqDDV-R-YRSTKECL  NSTLIHQSVTGLYETRIDLSQF--  1365
WP_049531101   1311  LSE---SFI  SLLKLTSPGAP-GAFRFLG--VEI--SQSnvR-YQSVSSCF  NATLIHQSITGLYETRIDLSKL--  1373
WP_049538452   1311  LSE---SFI  SLLKLTSPGAP-GAFKFLG--VEI--SQSsvR-YKPNSQFL  DATLIHQSITGLYETRIDLSKL--  1373
WP_049549711   1313  LSE---SFI  SLLKLTSPGAP-GAFKFLG--AEI--SQSsvR-YKPNSQFL  DTTLIHQSITGLYETRIDLSRF--  1375
WP_007896501   1312  -AL---NML  NLPFTSLGAP-STFVFFD--ETI--DRK--R-YTTSSDVL  NGILIQQSITGLYETRIDLSRP--  1371
EFR44625       1264  -AL---NML  NLPFTSLGAP-STFVFFD--ETI--DRK--R-YTTSSDVL  NGILIQQSVTGLYETRIDLSRF--  1323
WP_002897477   1307  LAN---SFI  NLLTFTAIGAP-AAFKFFG--KDV--SQSsvR-YKPNSQFL  NATLIHQSITGLYETRIDLSKL--  1367
WP_002906454   1312  LSE---SFI  SLLKLTSPGAP-GAFKFLG--VEI--SQSsvR-YKPNSQFL  DTTLIHQSITGLYETRIDLSKL--  1374
WP_009729476   1308  LAN---SFI  NLLTFTALGAP-AAFKFFG--KDV--DRK--R-YTTVSEIL  NATLIHQSVTGLYETRIDLSKL--  1368
CQR24647       1296  LAQ---SFI  SLLKFTAPGAP-GGFKFLD--ADI--KQSnlR-YQTVTEVL  SSTLIHQSVTGLYETRIDLSKL--  1358
WP_000066813   1312  LAN---SFI  NLLTFTAIGAP-AAFKFFG--KDV--DRK--R-YTTVSEIL  NATLIHQSITGLYETRIDLSKI--  1372
WP_009754323   1308  LAN---SFI  NLLTFTAIGAP-AAFKFLG--KDV--DRK--R-YTTVSEIL  NATLIHQSITGLYETRIDLSKL--  1368
WP_044674937   1301  LTS---SFV  NLLTFTAIGAP-AAFKFLG--SVI--DRK--R-YTSIAEIL  EATLIHQSVTGLYETRIDLSKL--  1361
WP_044676715   1303  LTS---SFV  NLLTFTAIGAP-AAFKFLG--SVI--DRK--R-YTSIAEIL  EATLIHQSVTGLYETRIDLSKL--  1363
```

| | | | | | |
|---|---|---|---|---|---|
| WP_044680361 | 1303 | LTS---SFV | NLLTFTAIGAP-AAFKFLG--SVI--DRK--R-YTSIAEIL | EATLIHQSVTGLYETRIDLSKL- | 1363 |
| WP_044681799 | 1301 | LTS---SFV | NLLTFTAIGAP-AAFKFLG--SVI--DRK--R-YTSIAEIL | EATLIHQSVTGLYETRIDLSKL- | 1361 |
| WP_049533112 | 1314 | ICT---SFL | GLFELTSLGSA-SDFEFLG--VKI--PRY--RdYTPSSLLK | DSTLIHQSITGLYETRIDLSKL- | 1383 |
| WP_029090905 | 1241 | -VK---VI | ELLKITQANATnGDLKLLK---M-sNREg-R-LGSVSVAL | DFKINQSVTGLYQSIEDYNN-- | 1300 |
| WP_006506696 | 1269 | -AN---II | QMLIVMHRGPQnGNIVYDDf--KI-sDRIg-R-LKTKNHNL | NIVFISQSPTGIYTKYKL---- | 1329 |
| AIT42264 | 1306 | -AE---NII | HLFTLTNLIGAP-AAFKFYD--TTI--DRK--R-YTSTKEVL | DATLIHQSITGLYETRIDLSQL- | 1365 |
| WP_034440723 | 1277 | LVE---SFI | NLLAITKCGPA-ADITFLG--EKI--SRK--R-YRSTNCLW | GSEVIFQSPTGLYETRLRLE-- | 1335 |
| AKQ21048 | 1306 | -AE---NII | HLFTLTNLIGAP-AAFKFYD--TTI--DRK--R-YTSTKEVL | DATLIHQSITGLYETRIDLSQL- | 1365 |
| WP_004636532 | 1272 | TVE---SFV | NLMTFTAMGAP-ATFKFYG--ESI--TRS--R-YTSITEFR | GSTLIFQSITGLYETRYKL--- | 1329 |
| WP_002364836 | 1278 | IAA---SFI | QLMQFNAMGAP-STFKFFQ--KDI--ERA--R-YTSIKEIF | DATIIYQSPTGLYETRRKV--- | 1335 |
| WP_016631044 | 1229 | IAA---SFI | QLMQFNAMGAP-STFKFFQ--KDI--ERA--R-YTSIKEIF | DATIIYQSPTGLYETRRKV--- | 1286 |
| EM575795 | 1014 | LSQ---SFI | NLMQLNAMGAP-ADFKFPD--VII--PRK--R-YPSLTEIW | ESTIIYQSITGLRETRTRMATLwd | 1076 |
| WP_002373311 | 1278 | IAA---SFI | QLMQFNAMGAP-STFKFFQ--KDI--ERA--R-YTSIKEIF | DATIIYQSTTGLYETRRKV--- | 1335 |
| WP_002378009 | 1278 | IAA---SFI | QLMQFNAMGAP-STFKFFQ--KDI--ERA--R-YTSIKEIF | DATIIYQSTTGLYETRRKV--- | 1335 |
| WP_024407324 | 1278 | IAA---SFI | QLMQFNAMGAP-STFKFFQ--KDI--ERA--R-YTSIKEIF | DATIIYQSTTGLYETRRKV--- | 1335 |
| WP_024413717 | 1278 | IAA---SFI | QLMQFNAMGAP-STFKFFQ--KDI--ERA--R-YTSIKEIF | DATIIYQSTTGLYETRRKV--- | 1335 |
| WP_010775580 | 1280 | IAA---SFI | QLMQFNAMGAP-STFKFFQ--KDI--ERA--R-YTSIKEIF | DATIIYQSTTGLYETRRKV--- | 1337 |
| WP_010818269 | 1278 | IAA---SFI | QLMQFNAMGAP-STFKFFQ--KDI--ERA--R-YTSIKEIF | DATIIYQSTTGLYETRRKV--- | 1335 |
| WP_010824395 | 1278 | IAA---SFI | QLMQFNAMGAP-STFKFFQ--KDI--ERA--R-YTSIKEIF | DATIIYQSTTGLYETRRKV--- | 1335 |
| WP_016622645 | 1278 | IAA---SFI | QLMQFNAMGAP-STFKFFQ--KDI--ERA--R-YTSIKEIF | DATIIYQSTTGLYETRRKV--- | 1335 |
| WP_033624816 | 1278 | IAA---SFI | QLMQFNAMGAP-STFKFFQ--KDI--ERA--R-YTSIKEIF | DATIIYQSTTGLYETRRKV--- | 1335 |
| WP_033625576 | 1278 | IAA---SFI | QLMQFNAMGAP-STFKFFQ--KDI--ERA--R-YTSIKEIF | DATIIYQSTTGLYETRRKV--- | 1335 |
| WP_033789179 | 1278 | IAA---SFI | QLMQFNAMGAP-STFKFFQ--KDI--ERA--R-YTSIKEIF | DATIIYQSTTGLYETRRKV--- | 1335 |
| WP_002310644 | 1280 | LAS---SFV | NLMQFNAMGAP-ADFKFPD--VTI--PRK--R-YTSLTEIW | QSTIIHQSITGLYETRIRMGK- | 1339 |
| WP_002312694 | 1281 | LAS---SFV | NLMQFNAMGAP-ADFKFPD--VTI--PRK--R-YTSLTEIW | QSTIIYQSITGLYETRIRMGK- | 1340 |
| WP_002314015 | 1281 | LAS---SFV | NLMQFNAMGAP-ADFKFPD--VTI--PRK--R-YTSLTEIW | QSTIIYQSITGLYETRIRMGK- | 1340 |
| WP_002320716 | 1280 | LAS---SFV | NLMQFNAMGAP-ADFKFPD--EKI--PRK--R-YVSISEII | QSTIIYQSITGLYETRIRMGK- | 1339 |
| WP_002330729 | 1281 | LAS---SFV | NLMQFNAMGAP-ADFKFPD--VTI--PRK--R-YTSLTEIW | QSTIIYQSITGLYETRIRMGK- | 1340 |
| WP_002335161 | 1281 | LAS---SFV | NLMQFNAMGAP-ADFKFPD--VTI--PRK--R-YTSLTEIW | QSTIIYQSITGLYETRIRMGK- | 1340 |
| WP_002345439 | 1281 | LAS---SFV | NLMQFNAMGAP-ADFKFPD--VTI--PRK--R-YTSLTEIW | QSTIIYQSITGLYETRIRMGK- | 1340 |
| WP_034867970 | 1271 | IAQ---SFL | QLLQFNAIGAP-ADFKFPG--VTI--PRK--R-YTSLTEIW | DATIIYQSVTGLYETRIRMGDLwa | 1333 |
| WP_047937432 | 1281 | LAS---SFV | NLMQFNAMGAP-ADFKFFG--VTI--PRK--R-YTSLTEIW | QSTIIYQSITGLYETRIRMGK- | 1340 |
| WP_010720994 | 1271 | IAQ---SFL | QLLQFNAIGAP-ADFKFPG--VTI--PRK--R-YTSLTEIW | DATIIYQSVTGLYETRIRMGDLwa | 1333 |
| WP_010737004 | 1271 | IAQ---SFL | QLLQFNAIGAP-ADFKFPG--VTI--PRK--R-YTSLTEIW | DATIIYQSVTGLYETRIRMGDLwa | 1333 |
| WP_034700478 | 1271 | IAQ---SFL | QLLQFNAIGAP-ADFEFFG--VTI--PRK--R-YTSLTEIW | DATIIYQSVTGLYETRVRLTEV- | 1330 |
| WP_007209003 | 1270 | IAK---SFI | NLLTFTAMGAP-ADFKFFD--EKI--PRK--R-YVSISEII | DAVFIHQSITGLYETRVRLTEV- | 1330 |
| WP_023519017 | 1265 | MID---AIL | SLLKFTLFGAS-VEFKKFD--IKI--LK--R-YKSLDIW | EATIIYQSVTGLYERRVEVRKLwd | 1326 |
| WP_010770040 | 1275 | IAE---SFV | NLMKFSAYGAP-MDFKKFG--KTI--PRS--R-YTSVGELL | SATINQSITGLYETRRKL--- | 1332 |
| WP_048604708 | 1271 | IAQ---SFV | DLMQLNAFGAP-ADFKFPD--ETI--PRK--R-YTSVNELL | EATINQSITGLYETRRRL--- | 1328 |
| WP_010750235 | 1274 | MAH---SFV | NLMQFNALGAP-ADFKFPD--TTI--TRK--R-YTSLTEIW | QSTIIYQSVTGLYETRRRMADLwd | 1336 |
| AII16583 | 1345 | -AE---NII | HLFTLTNLIGAP-AAFKFYD--TTI--DRK--R-YTSTKEVL | DATLIHQSITGLYETRIDLSQL- | 1404 |
| WP_029073316 | 1283 | -CE---VI | QMLVVMHAGPQnGNITFDDf--KL-sNRLg-R-LNCKTISL | TTVFIADSPTGMYSKKYKL--- | 1343 |
| WP_031589969 | 1284 | -CN---II | QILATLHCNSSiGKIMYSDf--KI-sTTig-R-LNGRTISL | DISFIAESPTGMYSKKYKL--- | 1344 |
| KDA45870 | 1254 | LGK---NFV | ELLRYTADGAA-SDFKFFG--ENI--PRK--R-YNSAGSLL | NGTLIYQSKTGLYETRIDLGKL | 1314 |
| WP_039099354 | 1307 | ILDr---V | -LIGLHANAAV-SDLGVLKisTPL-GKM--Q---QPSGIS | DTQIIYQSPTGLFERRVALRDL | 1368 |
| AKP02966 | 1297 | INS1-eELI | TLLHANSTSAH-LIFNNIE-kKAF--GRK-----THGLT | DTDFIYQSVTGLYETRIHIE-- | 1356 |
| WP_010991369 | 1275 | IAQ---SFV | DLMAFNAMGAP-ASFKFFE--TTI--ERK--R-YNNLKELL | NSTIIYQSITGLYESRKRL--- | 1332 |
| WP_033838504 | 1278 | IAQ---SFV | DLMAFNAMGAP-ASFKFFE--TTI--ERK--R-YNNLKELL | NSTIIYQSITGLYESRKRL--- | 1335 |
| EHN60060 | 1044 | IAQ---SFV | DLMAFNAMGAP-ASFKFFE--TTI--ERK--R-YNNLKELL | NSTIIYQSITGLYESRKRL--- | 1101 |
| EFR89594 | 1275 | IAQ---SFD | KLKVFNAFGAP-RDFEFFE--TTI--KRK--R-YYNLKELL | NATIIYQSITGLYEARKRL--- | 1332 |
| WP_038409211 | 894 | IAK---SFD | KLKVFNAFGAP-RDFEFFE--TTI--KRK--R-YYNIKELL | NATIIYQSITGLYEARKRL--- | 951 |
| EFR95520 | 1275 | IAQ---SFV | DLMAFNAMGAP-ASFKFFE--ATI--DRK--R-YTNLKELL | SSTIIYQSITGLYESRKRL--- | 1332 |
| WP_003723650 | | | | | |

| | | | | |
|---|---|---|---|---|
| WP_003727705 | 1275 | IAQ---SFV | DLMAFNAMGAP-ASFKFFE--ATI-DRK--R-YTNLKELL | SSTIIYQSITGLYESRKRL----- | 1332 |
| WP_003730785 | 1275 | IAQ---SFV | DLMAFNAMGAP-ASFKFFE--ATI-DRK--R-YTNLKELL | SSTIIYQSITGLYESRKRL----- | 1332 |
| WP_003733029 | 1275 | IAE---SFV | SLKKFNAFGVH-QDFSFFG--TKI-ERK--R-DRKLNELL | NSTIIYQSITGLYESRKRL----- | 1332 |
| WP_003739838 | 1275 | IAQ---SFV | NLMAFNAMGAP-ASFKFFE--ATI-ERK--R-YTNLKELL | SATIIYQSITGLYEARKRL----- | 1332 |
| WP_014601172 | 1275 | IAQ---SFV | DLMAFNAMGAP-ASFKFFE--ATI-DRK--R-YTNLKELL | SSTIIYQSITGLYESRKRL----- | 1332 |
| WP_023548323 | 1275 | IAE---SFV | SLKKFNAFGVH-KDFNFFG--TTI-KRK--R-DRKLKELL | SSTIIYQSITGLYESRKRL----- | 1332 |
| WP_031665337 | 1275 | IAQ---SFV | DLMAFNAMGAP-ASFKFFE--ATI-DRK--R-YTNLKELL | SSTIIYQSITGLYESRKRL----- | 1332 |
| WP_031669209 | 1275 | IAE---SFV | SLKKFNAFGVH-QDFSFFG--TKI-ERK--R-DRKLNELL | NSTIIYQSITGLYESRKRL----- | 1332 |
| WP_033920898 | 1275 | IAE---SFV | SLKKFNAFGVH-QDFSFFG--TKI-KRK--R-DRKLKELL | NSTIIYQSITGLYESRKRL----- | 1332 |
| AKI42028 | 1278 | IAE---SFV | DLMAFNAMGAP-ASFKFFE--ATI-DRK--R-YTNLKELL | SSTIIYQSITGLYESRKRL----- | 1335 |
| AKI50529 | 1278 | IAE---SFV | SLKKFNAFGVH-KDFNFFG--TTI-KRK--R-DRKLKELL | NSTIIYQSITGLYESRKRL----- | 1335 |
| EFR83390 | 723 | IAQ---SFV | DLMVFNAMGAP-ASFKYPE--TNI-ERK--R-YNNLKELL | SSTIIYQSITGLYESRKRL----- | 780 |
| WP_046323366 | 1275 | -AE---NII | HLFTLTNLGAP-AAFKYFD--TTI-DRK--R-YTSTKEVL | NATIIYQSITGLYEARKRL----- | 1332 |
| AKE81011 | 1322 | -AE---NII | QMLIIMHKGPQnGNIIYDDf-NV-gKRig-R-LNGRTFYL | DATLIHQSITGLYETRIDLSQL- | 1381 |
| CUO82355 | 1273 | -AN---VI | QILIIMHAGPMnGNIMYDDf--KF-tNRig-R-FTHKNIDL | NIEFISQSPTGIYTKKYKL----- | 1333 |
| WP_031162887 | 1275 | -CD---VI | HLFTLTNLGAP-AAFKYFD--TTI-DRK--R-YTSTKEVL | KTTFISTSVTGLFSKKYKL----- | 1335 |
| AGZ01981 | 1339 | -AE---NII | HLFTLTNLGAP-AAFKYFD--TTI-DRK--R-YTSTKEVL | DATLIHQSITGLYETRIDLSQL- | 1398 |
| AKA60242 | 1306 | -AE---NII | HLFTLTNLGAP-AAFKYFD--TTI-DRK--R-YTSTKEVL | DATLIHQSITGLYETRIDLSQL- | 1365 |
| AKS40380 | 1310 | -AE---NII | HLFTLTNLGAP-AAFKYFD--TTI-DRK--R-YTSTKEVL | DATLIHQSITGLYETRIDLSQL- | 1369 |
| 4UN5_B | 1310 | | | | |
| WP_010922251 | 1366 | GGD | | | 1368 |
| WP_039695303 | 1370 | GEE | | | 1372 |
| WP_045635197 | 1368 | GED | | | 1370 |
| 5AXW_A | | --- | | | |
| WP_009880683 | 1050 | GGD | | | 1052 |
| WP_010922251 | 1366 | GGD | | | 1368 |
| WP_011054416 | 1366 | GGD | | | 1368 |
| WP_011284745 | 1366 | GGD | | | 1368 |
| WP_011285506 | 1366 | GGD | | | 1368 |
| WP_011527619 | 1366 | GGD | | | 1368 |
| WP_012560673 | 1365 | GGD | | | 1367 |
| WP_014407541 | 1366 | GGD | | | 1368 |
| WP_020905136 | 1365 | GGD | | | 1367 |
| WP_023080005 | 1365 | GGD | | | 1367 |
| WP_023610282 | 1366 | GGD | | | 1368 |
| WP_030125963 | 1366 | GGD | | | 1368 |
| WP_030126706 | 1366 | GGD | | | 1368 |
| WP_031488318 | 1366 | GGD | | | 1368 |
| WP_032460140 | 1366 | GGD | | | 1368 |
| WP_032461047 | 1366 | GGD | | | 1368 |
| WP_032462016 | 1366 | GGD | | | 1368 |
| WP_032462936 | 1366 | GGD | | | 1368 |
| WP_032464890 | 1366 | GGD | | | 1368 |
| WP_033888930 | 1191 | GGD | | | 1193 |
| WP_038431314 | 1365 | GGD | | | 1367 |
| WP_038432938 | 1366 | GGD | | | 1368 |
| WP_038434062 | 1366 | GGD | | | 1368 |
| BAQ51233 | 1277 | GGD | | | 1279 |
| KGE60162 | 541 | GGD | | | 543 |
| KGE60856 | 304 | GGD | | | 306 |
| WP_002989955 | 1366 | GGD | | | 1368 |
| WP_003030002 | 1343 | GED | | | 1345 |
| WP_003065552 | 1371 | GEE | | | 1373 |

-continued

| | | | |
|---|---|---|---|
| WP_001040076 | 1368 | GED | 1370 |
| WP_001040078 | 1376 | GED | 1378 |
| WP_001040080 | 1368 | GED | 1370 |
| WP_001040081 | 1368 | GED | 1370 |
| WP_001040083 | 1368 | GED | 1370 |
| WP_001040085 | 1368 | GED | 1370 |
| WP_001040087 | 1368 | GGD | 1370 |
| WP_001040088 | 1368 | GED | 1370 |
| WP_001040089 | 1368 | GED | 1370 |
| WP_001040090 | 1368 | GED | 1370 |
| WP_001040091 | 1368 | GED | 1370 |
| WP_001040092 | 1368 | GED | 1370 |
| WP_001040094 | 1368 | GED | 1370 |
| WP_001040095 | 1368 | GEG | 1370 |
| WP_001040096 | 1368 | GED | 1370 |
| WP_001040097 | 1368 | GED | 1370 |
| WP_001040098 | 1368 | GED | 1370 |
| WP_001040099 | 1368 | GED | 1370 |
| WP_001040100 | 1368 | GED | 1370 |
| WP_001040104 | 1368 | GED | 1370 |
| WP_001040105 | 1368 | GED | 1370 |
| WP_001040106 | 1368 | GED | 1370 |
| WP_001040107 | 1368 | GED | 1370 |
| WP_001040108 | 1368 | GED | 1370 |
| WP_001040109 | 1368 | GED | 1370 |
| WP_001040110 | 1368 | GED | 1370 |
| WP_015058523 | 1368 | GED | 1370 |
| WP_017643650 | 1368 | GED | 1370 |
| WP_017647151 | 1368 | GED | 1370 |
| WP_017648376 | 1368 | GED | 1370 |
| WP_017649527 | 1368 | GED | 1370 |
| WP_017771611 | 1368 | GED | 1370 |
| WP_017771984 | 1368 | GED | 1370 |
| CFQ25032 | 1368 | GED | 1370 |
| CFV16040 | 1368 | GED | 1370 |
| KLJ37842 | 1368 | GGD | 1370 |
| KLJ72361 | 1368 | GED | 1370 |
| KLL20707 | 1382 | GED | 1384 |
| KLL42645 | 1368 | GED | 1370 |
| WP_047207273 | 1368 | GED | 1370 |
| WP_047209694 | 1368 | GED | 1370 |
| WP_050198062 | 1368 | GED | 1370 |
| WP_050201642 | 1368 | GED | 1370 |
| WP_050204027 | 1368 | GED | 1370 |
| WP_050881965 | 1368 | GED | 1370 |
| WP_050886065 | 1368 | GED | 1370 |
| AHN30376 | 1368 | GED | 1370 |
| EA078426 | 1368 | GED | 1370 |
| CCW42055 | 1368 | GED | 1370 |
| WP_003041502 | 1384 | GED | 1386 |
| WP_037593752 | 1344 | GED | 1346 |
| WP_049516684 | 1344 | GED | 1346 |
| GAD46167 | 1343 | GED | 1345 |

-continued

| | | | | | |
|---|---|---|---|---|---|
| WP_018363470 | 1375 | GEE | 1377 |
| WP_003043819 | 1373 | GGD | 1375 |
| WP_006269658 | 1343 | GED | 1345 |
| WP_048800889 | 1363 | GED | 1365 |
| WP_012767106 | 1369 | GGD | 1371 |
| WP_014612333 | 1369 | GGD | 1371 |
| WP_015017095 | 1369 | GGD | 1371 |
| WP_015057649 | 1369 | GGD | 1371 |
| WP_048327215 | 1369 | GGD | 1371 |
| WP_049519324 | 1346 | GEN | 1348 |
| WP_012515931 | 1346 | GEN | 1348 |
| WP_021320964 | 1346 | GEN | 1348 |
| WP_037581760 | 1375 | GEE | 1377 |
| WP_004232481 | 1368 | GEE | 1370 |
| WP_009854540 | 1369 | GEE | 1371 |
| WP_012962174 | 1370 | GEE | 1372 |
| WP_039695303 | 1373 | GEE | 1375 |
| WP_014334983 | 1366 | GGK | 1368 |
| WP_030992269 | | | |
| AHY15608 | | | |
| AHY17476 | 198 | GGK | 200 |
| ESR09100 | 1343 | GGD | 1345 |
| AGM98575 | 1351 | GEN | 1353 |
| ALF27331 | 1374 | GED | 1376 |
| WP_018372492 | 1368 | GED | 1370 |
| WP_045618028 | 1343 | GGD | 1345 |
| WP_045635197 | 1343 | GGD | 1345 |
| WP_002263549 | 1343 | GGD | 1345 |
| WP_002263887 | 1343 | GGD | 1345 |
| WP_002264920 | 1343 | GGD | 1345 |
| WP_002269043 | 1343 | GGD | 1345 |
| WP_002269448 | 1343 | GGD | 1345 |
| WP_002271977 | 1343 | GGD | 1345 |
| WP_002272766 | 1343 | GGD | 1345 |
| WP_002273241 | 1353 | GGD | 1355 |
| WP_002275430 | 1343 | GGD | 1345 |
| WP_002276448 | 1343 | GGD | 1345 |
| WP_002277050 | 1343 | GGD | 1345 |
| WP_002277364 | 1343 | GGD | 1345 |
| WP_002279025 | 1343 | GGD | 1345 |
| WP_002279859 | 1343 | GGD | 1345 |
| WP_002280230 | 1343 | GGD | 1345 |
| WP_002281696 | 1343 | GGD | 1345 |
| WP_002282247 | 1353 | GGD | 1355 |
| WP_002282906 | 1343 | GGD | 1345 |
| WP_002283846 | 1343 | GGD | 1345 |
| WP_002287255 | 1343 | GGD | 1345 |
| WP_002288990 | 1343 | GGD | 1345 |
| WP_002289641 | 1343 | GGD | 1345 |
| WP_002290427 | 1343 | GGD | 1345 |
| WP_002295753 | 1343 | GGD | 1345 |
| WP_002296423 | 1343 | GGD | 1345 |
| WP_002304487 | 1357 | GGD | 1359 |

| | | | |
|---|---|---|---|
| WP_002305844 | 1343 | GGD | 1345 |
| WP_002307203 | 1343 | GGD | 1345 |
| WP_002310390 | 1343 | GGD | 1345 |
| WP_002352408 | 1343 | GGD | 1345 |
| WP_012997688 | 1343 | GGD | 1345 |
| WP_014677909 | 1343 | GGD | 1345 |
| WP_019312892 | 1343 | GGD | 1345 |
| WP_019313659 | 1343 | GGD | 1345 |
| WP_019314093 | 1343 | GGD | 1345 |
| WP_019315370 | 1343 | GGD | 1345 |
| WP_019803776 | 1343 | GGD | 1345 |
| WP_019805234 | 1343 | GGD | 1345 |
| WP_024783594 | 1343 | GGD | 1345 |
| WP_024784288 | 1353 | GGD | 1355 |
| WP_024784666 | 1343 | GGD | 1345 |
| WP_024784894 | 1343 | GGD | 1345 |
| WP_024786433 | 1353 | GGD | 1355 |
| WP_049473442 | 1343 | GGD | 1345 |
| WP_049474547 | 1343 | GGD | 1345 |
| EMC03581 | 1336 | GGD | 1338 |
| WP_000428612 | 1371 | GED | 1373 |
| WP_000428613 | 1369 | GED | 1371 |
| WP_049523028 | 1364 | GEE | 1366 |
| WP_003107102 | 1335 | GED | 1337 |
| WP_054279288 | 1366 | GGD | 1368 |
| WP_049531101 | 1374 | GED | 1376 |
| WP_049538452 | 1374 | GED | 1376 |
| WP_049549711 | 1376 | GED | 1378 |
| WP_007896501 | 1372 | GGD | 1374 |
| EFR44625 | 1324 | GGD | 1326 |
| WP_002897477 | 1368 | GEE | 1370 |
| WP_002906454 | 1375 | GED | 1377 |
| WP_009729476 | 1369 | GED | 1371 |
| CQR24647 | 1359 | GGE | 1361 |
| WP_000066813 | 1373 | GED | 1375 |
| WP_009754323 | 1369 | GED | 1371 |
| WP_044674937 | 1362 | GED | 1364 |
| WP_044676715 | 1364 | GGD | 1366 |
| WP_044680361 | 1364 | GGD | 1366 |
| WP_044681799 | 1362 | GGD | 1364 |
| WP_049533112 | 1384 | GED | 1386 |
| WP_029090905 | | | |
| WP_006506696 | | | |
| AIT42264 | 1366 | GGD | 1389 |
| WP_034440723 | | | |
| AKQ21048 | 1366 | GGD | 1384 |
| WP_004636532 | 1330 | -ED | 1332 |
| WP_002364836 | 1336 | -VD | 1337 |
| WP_016631044 | 1287 | -VD | 1288 |
| EMS75795 | 1077 | GEQ | 1079 |
| WP_002373311 | 1336 | -VD | 1337 |
| WP_002378009 | 1336 | -VD | 1337 |
| WP_002407324 | 1336 | -VD | 1337 |

-continued

| | | | | |
|---|---|---|---|---|
| WP_002413717 | 1336 | -VD | 1337 | |
| WP_010775580 | 1338 | -VD | 1339 | |
| WP_010818269 | 1336 | -VD | 1337 | |
| WP_010824395 | 1336 | -VD | 1337 | |
| WP_016622645 | 1336 | -VD | 1337 | |
| WP_033624816 | 1336 | -VD | 1337 | |
| WP_033625576 | 1336 | -VD | 1337 | |
| WP_033789179 | 1336 | -VD | 1337 | |
| WP_002310644 | | | | |
| WP_002312694 | | | | |
| WP_002314015 | | | | |
| WP_002320716 | | | | |
| WP_002330729 | | | | |
| WP_002335161 | | | | |
| WP_002345439 | | | | |
| WP_034867970 | 1334 | GEQ | 1336 | |
| WP_047937432 | | | | |
| WP_010720994 | 1334 | GEQ | 1336 | |
| WP_010737004 | 1334 | GEQ | 1336 | |
| WP_034700478 | 1334 | GEQ | 1336 | |
| WP_007209003 | | | | |
| WP_023519017 | 1327 | GER | 1330 | |
| WP_010770040 | 1333 | -VD | 1334 | |
| WP_048604708 | 1329 | -GD | 1330 | |
| WP_010750235 | 1337 | GVQ | 1339 | |
| A1l6583 | 1405 | GGD | 1424 | |
| WP_029073316 | | | | |
| WP_031589969 | | | | |
| KDA45870 | | | | |
| WP_039099354 | | | | |
| AKP02966 | | | | |
| WP_010991369 | 1333 | -DD | 1334 | |
| WP_033838504 | 1333 | -DD | 1334 | |
| EHN60060 | 1336 | -DD | 1337 | |
| WP_038409211 | 1102 | -DD | 1103 | |
| EFR89594 | 1333 | -ED | 1334 | |
| EFR95520 | 952 | -ED | 953 | |
| WP_003723650 | 1333 | -DD | 1334 | |
| WP_003727705 | 1333 | -DD | 1334 | |
| WP_003730785 | 1333 | -DD | 1334 | |
| WP_003733029 | 1333 | -DN | 1334 | |
| WP_003739838 | 1333 | -DG | 1334 | |
| WP_014601172 | 1333 | -DD | 1334 | |
| WP_023548323 | 1333 | -DS | 1334 | |
| WP_031665337 | 1333 | -DD | 1334 | |
| WP_031669209 | 1333 | -DN | 1334 | |
| WP_033920898 | 1333 | -DS | 1334 | |
| AKI42028 | 1336 | -DD | 1337 | |
| AKI50529 | 1336 | -DS | 1337 | |
| EFR83390 | 781 | -DD | 782 | |
| WP_046323366 | 1333 | -DD | 1334 | |
| AKE81011 | 1382 | GGD | 1400 | |
| CU082355 | | | | |

-continued

| | | | |
|---|---|---|---|
| WP_033162887 | 1399 | GGD | 1417 |
| AGZ01981 | 1366 | GGD | 1368 |
| AKA60242 | 1366 | GGD | 1376 |
| AKS40380 | 1370 | GGD | 1372 |
| 4UN5_B | | | |

EQUIVALENTS AND SCOPE, INCORPORATION BY REFERENCE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (5526 sequences)

SEQ ID NO: 1 - protein, 167 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - protein, 8 aa, Artificial Sequence
  Synthetic Polypeptide
SGGSSGGS

SEQ ID NO: 3 - protein, 84 aa, Artificial Sequence
  Synthetic Polypeptide
MTNLSDIIEKETGKQLVIQESILMLPEEVEEVIGNKPESDILVHTAYDESTDENVMLLTSDAPEYKPWALVIQDSNGENKIKML

SEQ ID NO: 4 - protein, 7 aa, Artificial Sequence
  Synthetic Polypeptide
PKKKRKV

SEQ ID NO: 5 - protein, 30 aa, Artificial Sequence
  Synthetic Polypeptide
MDSLLMNRRKFLYQFKNVRWAKGRRETYLC

SEQ ID NO: 6 - DNA, 23 bp, Artificial Sequence
  Synthetic Polynucleotide
gaacacaaagcatagactgcggg

SEQ ID NO: 7 - DNA, 23 bp, Artificial Sequence
  Synthetic Polynucleotide
gaacacaaagcatagactgctgg

SEQ ID NO: 8 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 9 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 10 - protein, 16 aa, Artificial Sequence
  Synthetic Polypeptide
SGSETPGTSESATPES

SEQ ID NO: 11 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 12 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 13 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 14 - protein, 1561 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 15 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 16 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 17 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 18 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 19 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 20 - protein, 1648 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 21 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 22 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 23 - protein, 1784 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 24 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 25 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 26 - protein, 1787 aa, Artificial Sequence
  Synthetic Polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 27 - protein, 1550 aa, Artificial Sequence
  Synthetic Polypeptide
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1550 aa, Artificial Sequence
  Synthetic Polypeptide
  misc_feature (155)..(155): Xaa can be any naturally occurring amino acid
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQXIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 30 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 31 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 32 - protein, 219 aa, Artificial Sequence
  Synthetic Polypeptide
KGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 33 - protein, 222 aa, Artificial Sequence
  Synthetic Polypeptide
DLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQP

SEQ ID NO: 34 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Artificial Sequence
  Synthetic Polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 4 aa, Artificial Sequence
  Synthetic Polypeptide
SGGS

SEQ ID NO: 38 - protein, 4 aa, Artificial Sequence
  Synthetic Polypeptide
GGGS

SEQ ID NO: 39 - protein, 5 aa, Artificial Sequence
  Synthetic Polypeptide
GGGGS

SEQ ID NO: 40 - protein, 5 aa, Artificial Sequence
  Synthetic Polypeptide
EAAAK

SEQ ID NO: 41 - DNA, 23 bp, Artificial Sequence
  Synthetic Polynucleotide
cccgcagtctatgctttgtgttc

SEQ ID NO: 42 - DNA, 23 bp, Artificial Sequence
  Synthetic Polynucleotide
ggcccagactgagcacgtgatgg

SEQ ID NO: 43 - DNA, 23 bp, Artificial Sequence
  Synthetic Polynucleotide
ggcactgcggctggaggtggggg

SEQ ID NO: 44 - DNA, 23 bp, Artificial Sequence
  Synthetic Polynucleotide
gtcatcttagtcaggacctgagg

SEQ ID NO: 45 - DNA, 23 bp, Artificial Sequence
  Synthetic Polynucleotide
ggaatcccttctgcagcacctgg

SEQ ID NO: 46 - DNA, 23 bp, Artificial Sequence
  Synthetic Polynucleotide
gagtccgagcagaagaagaaggg

SEQ ID NO: 47 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 48 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - DNA, 4212 bp, Artificial Sequence
  Synthetic Polynucleotide
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 50 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 52 - protein, 1368 aa, Streptococcus pyogenes [sequence omitted]

SEQ ID NO: 53 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1368 aa, Artificial Sequence; identical to SEQ ID NO: 53
  Synthetic Polypeptide

SEQ ID NO: 55 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 56 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 57 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 58 - protein, 1367 aa, Artificial Sequence; identical to SEQ ID NO: 36
  Synthetic Polypeptide

SEQ ID NO: 59 - protein, 1367 aa, Artificial Sequence; identical to SEQ ID NO: 35
  Synthetic Polypeptide

SEQ ID NO: 60 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 61 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 62 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 63 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 64 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 65 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 66 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 67 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 68 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 69 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 70 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 71 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 72 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 73 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 74 - protein, 166 aa, Artificial Sequence
  Synthetic Polypeptide
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 75 - protein, 166 aa, Artificial Sequence
  Synthetic Polypeptide
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 76 - protein, 166 aa, Artificial Sequence
  Synthetic Polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 77 - protein, 166 aa, Artificial Sequence
  Synthetic Polypeptide
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 78 - protein, 166 aa, Artificial Sequence
  Synthetic Polypeptide
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 79 - protein, 166 aa, Artificial Sequence
  Synthetic Polypeptide
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 80 - protein, 166 aa, Artificial Sequence
  Synthetic Polypeptide
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 81 - protein, 166 aa, Artificial Sequence
  Synthetic Polypeptide
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 82 - protein, 166 aa, Artificial Sequence
  Synthetic Polypeptide
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 83 - protein, 166 aa, Artificial Sequence
  Synthetic Polypeptide
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 84 - protein, 178 aa, E. coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 85 - DNA, 23 bp, Artificial Sequence
  Synthetic Polynucleotide
tatatgcatatttattacatcgg

SEQ ID NO: 86 - DNA, 23 bp, Artificial Sequence
  Synthetic Polynucleotide
ccgtcatgtgggtcctgaattgg

SEQ ID NO: 87 - DNA, 23 bp, Artificial Sequence
  Synthetic Polynucleotide
acactgaaagactccaggtcagg

SEQ ID NO: 88 - DNA, 23 bp, Artificial Sequence
  Synthetic Polynucleotide
gtcagaagagatgtggtcaatgg

SEQ ID NO: 89 - DNA, 23 bp, Artificial Sequence
  Synthetic Polynucleotide
tttaaagtgaagcagcatctggg

SEQ ID NO: 90 - DNA, 23 bp, Artificial Sequence
  Synthetic Polynucleotide
atttaaagtgaagcagcatctgg

SEQ ID NO: 91 - DNA, 23 bp, Artificial Sequence
  Synthetic Polynucleotide
actccatgacagtgtaattttgg

SEQ ID NO: 92 - DNA, 23 bp, Artificial Sequence
  Synthetic Polynucleotide
gcctggagaagccatccagcagg

SEQ ID NO: 93 - DNA, 23 bp, Artificial Sequence
  Synthetic Polynucleotide
ctcagacacactcattgatgagg

SEQ ID NO: 94 - DNA, 24 bp, Artificial Sequence
  Synthetic Polynucleotide
gaggcactgcccccaccatgagcg

SEQ ID NO: 95 - DNA, 85 bp, Artificial Sequence
  Synthetic Polynucleotide
tcataagcattctgccgacatggaagccgtcgcatacggtgtggtgcacctggatggccagcggcatcagcaccttgtcgccttg

SEQ ID NO: 96 - protein, 29 aa, Artificial Sequence
  Synthetic Polypeptide
ENLMRGVHFGDCVTHHVQIALPMLVKDGQ

SEQ ID NO: 97 - DNA, 86 bp, Artificial Sequence
  Synthetic Polynucleotide
tcattaagcattctgccgacatggaagccgtcgcatacggcgcggtgcacctggatggccagcggcatcagcaccttgtcgccttg

SEQ ID NO: 98 - protein, 29 aa, Artificial Sequence
  Synthetic Polypeptide
ENLMRGVHFGDCVARHVQIALPMLVKDGQ

SEQ ID NO: 99 - DNA, 59 bp, Artificial Sequence
  Synthetic Polynucleotide
ccgtcgcatacggtgtggtgcacctggatggccagcggcatcagcaccttgtcgccttg

SEQ ID NO: 100 - DNA, 96 bp, Artificial Sequence
  Synthetic Polynucleotide
caaatattatacgcaaggcgacaaggtgctgatgccgctggccatccaggtgcaccacgccgtatgcgacggcttccatgtcggcagaatgcttaa

SEQ ID NO: 101 - protein, 32 aa, Artificial Sequence
  Synthetic Polypeptide
KYYTQGDKVLMPLAIQVHHAVCDGFHVGRMLN

SEQ ID NO: 102 - DNA, 96 bp, Artificial Sequence
  Synthetic Polynucleotide
caaatattatacgcaaggcgacaaggtgctgatgccgctggccatccaggtgcactacgccgtatgcgacggcttccatgtcggcagaatgcttaa

SEQ ID NO: 103 - protein, 32 aa, Artificial Sequence
  Synthetic Polypeptide
KYYTQGDKVLMPLAIQVHYAVCDGFHVGRMLN

SEQ ID NO: 104 - DNA, 86 bp, Artificial Sequence
  Synthetic Polynucleotide
caaatattatacgcaaggcgacaaggtgctgatgccgctggccatccaggtgcaccacgccgtatgcgacggctccagtcgccaaa

SEQ ID NO: 105 - protein, 84 aa, Artificial Sequence
  Synthetic Polynucleotide
  misc_feature (1)..(3): Xaa can be any naturally occurring amino acid
  misc_feature (6)..(8): Xaa can be any naturally occurring amino acid
  misc_feature (23)..(26): Xaa can be any naturally occurring amino acid
  misc_feature (30)..(30): Xaa can be any naturally occurring amino acid
  misc_feature (34)..(34): Xaa can be any naturally occurring amino acid
  misc_feature (37)..(37): Xaa can be any naturally occurring amino acid
  misc_feature (39)..(39): Xaa can be any naturally occurring amino acid
  misc_feature (41)..(41): Xaa can be any naturally occurring amino acid
  misc_feature (43)..(44): Xaa can be any naturally occurring amino acid
  misc_feature (50)..(50): Xaa can be any naturally occurring amino acid
  misc_feature (52)..(56): Xaa can be any naturally occurring amino acid
  misc_feature (60)..(64): Xaa can be any naturally occurring amino acid
  misc_feature (66)..(66): Xaa can be any naturally occurring amino acid
  misc_feature (68)..(70): Xaa can be any naturally occurring amino acid
  misc_feature (72)..(73): Xaa can be any naturally occurring amino acid
  misc_feature (76)..(77): Xaa can be any naturally occurring amino acid
  misc_feature (80)..(82): Xaa can be any naturally occurring amino acid
  misc_feature (84)..(84): Xaa can be any naturally occurring amino acid
XXXRLXXXTLYVTLEPCVMCAGXXXXSRIXRVVXGAXDXKXGXXGSLMBXLXXXXXNHRXXXXXGXLXXXCXXLLXXFFXXXRX

SEQ ID NO: 106 - protein, 84 aa, Artificial Sequence
  Synthetic Polypeptide
QNYRLIDATLYVTLEPCVMCAGAMIHSRIGRVVFGARDAKTGAAGSLMDVLHHPGMNHRVEITEGILADECAALLSDFFRMRRQ

SEQ ID NO: 107 - protein, 84 aa, Artificial Sequence
  Synthetic Polypeptide
GSWRLEGCTLYVTLEPCVMCAGTIVMSRIPRVVYGADDPKGGCSGSLMNLLQQSNFNHRAIVDKGVLKEACSTLLTTFFKNLRA

SEQ ID NO: 108 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 109 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 110 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 111 - protein, 986 aa, Staphylococcus Aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 112 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 113 - protein, 1359 aa, Streptococcus pyogenes; identical to SEQ ID NO: 108

SEQ ID NO: 114 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 115 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 116 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 117 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 118 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 119 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 120 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 121 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 122 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 123 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 124 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 125 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 126 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 127 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 128 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 129 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 130 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 131 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 132 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 133 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 134 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 135 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 136 - protein, 536 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 137 - protein, 305 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 138 - protein, 1359 aa, Artificial Sequence
  Synthetic Polypeptide
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 139 - protein, 1341 aa, Artificial Sequence
  Synthetic Polypeptide
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 140 - protein, 1356 aa, Artificial Sequence
  Synthetic Polypeptide
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 141 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 142 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 143 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 144 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 145 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 146 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 147 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 148 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 149 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 150 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 151 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 152 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 153 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 154 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 155 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 156 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 157 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 158 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 159 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 160 - protein, 1365 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 161 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 162 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 163 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 164 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 165 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 166 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 167 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 168 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 169 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 170 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 171 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 172 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 173 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 174 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 175 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 176 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 177 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 178 - protein, 1365 aa, Streptococcus agalactiae; identical to SEQ ID NO: 147

SEQ ID NO: 179 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 180 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 181 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 182 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 183 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 184 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 185 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 186 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 187 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 188 - protein, 1365 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 189 - protein, 1365 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 190 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 191 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 192 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 193 - protein, 1341 aa, Streptococcus anginosus; identical to SEQ ID NO: 191

SEQ ID NO: 194 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 195 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 196 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 197 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 198 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 199 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 200 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 201 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 202 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 203 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 204 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 205 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 206 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 207 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 208 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 209 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 210 - protein, 1355 aa, Streptococcus gallolyticus; identical to SEQ ID NO: 109

SEQ ID NO: 211 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 212 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 213 - protein, 1263 aa, Streptococcus iniae
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 214 - protein, 1257 aa, Streptococcus iniae
  misc_feature (1255)..(1255): Xaa can be any naturally occurring amino acid
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 215 - protein, 199 aa, Streptococcus iniae
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 216 - protein, 1271 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 217 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 218 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 219 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 220 - protein, 1359 aa, Streptococcus mitis; identical to SEQ ID NO: 110

SEQ ID NO: 221 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 222 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 223 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 224 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 225 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 226 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 227 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 228 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 229 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 230 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 231 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 232 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 233 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 234 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 235 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 236 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 237 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 238 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 239 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 240 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 241 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 242 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 243 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 244 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 245 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 246 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 247 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 248 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 249 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 250 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 251 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 252 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 253 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 254 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 255 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 256 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 257 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 258 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 259 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 260 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 261 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 262 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 263 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 264 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 265 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 266 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 267 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 268 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 269 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 270 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 271 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 272 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 273 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 274 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 275 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 276 - protein, 1316 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 277 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 278 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 279 - protein, 1360 aa, Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 280 - protein, 1360 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 281 - protein, 1364 aa, Streptococcus sp. M334
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 282 - protein, 1360 aa, Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 283 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 284 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 285 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 286 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 287 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 288 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 289 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 290 - protein, 1359 aa, Artificial Sequence; identical to SEQ ID NO: 108
  Synthetic Polypeptide

SEQ ID NO: 291 - protein, 1317 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 292 - protein, 1359 aa, Artificial Sequence; identical to SEQ ID NO: 108
  Synthetic Polypeptide

SEQ ID NO: 293 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 294 - protein, 1329 aa, Artificial Sequence
  Synthetic Polypeptide
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 295 - protein, 1280 aa, Artificial Sequence
  Synthetic Polypeptide
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 296 - protein, 1072 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 297 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 298 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 299 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 300 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 301 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 302 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 303 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 304 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 305 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 306 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 307 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 308 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 309 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 310 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 311 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 312 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 313 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 314 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 315 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 316 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 317 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 318 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 319 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 320 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

(The sequence listing continues in the following parts.)

What is claimed is:

1. An adenosine deaminase comprising an amino acid sequence that is at least 90% identical to the amino acid sequence of SEQ ID NOs: 1, 8, 9, 371, 372, 373, 374, or 375 with the exception of one or more substitutions at positions selected from the group consisting of amino acid residues corresponding to positions 8, 17, 18, 23, 34, 36, 45, 48, 51, 56, 59, 84, 85, 94, 95, 102, 104, 106, 107, 108, 110, 118, 123, 127, 138, 142, 146, 147, 149, 151, 152, 153, 154, 155, 156, and 157 of the amino acid sequence of SEQ ID NO: 1, wherein said adenosine deaminase deaminates adenine in deoxyribonucleic acid (DNA).

2. A base editor for modifying a base within a nucleic acid sequence, wherein said base editor comprises:

a nucleic acid programmable DNA binding protein (napDNAbp) domain, wherein said napDNAbp domain when in conjunction with a bound nucleic acid, site specifically binds a nucleic acid sequence; and
the adenosine deaminase of claim 1.

3. The base editor of claim 2, wherein said napDNAbp domain comprises a Cas9 domain, a Cpf1 domain, a CasX domain, a CasY domain, a C2c1 domain, a C2c2 domain, or a C2c3domain.

4. The base editor of claim 3, wherein said napDNAbp domain comprises a Cas9 domain.

5. The base editor of claim 4, wherein said Cas9 domain comprises a nuclease dead Cas9 (dCas9), a Cas9 nickase (nCas9), or a nuclease active Cas9.

6. The base editor of claim 5, wherein said Cas9 domain comprises a nuclease dead Cas9 (dCas9).

7. The base editor of claim 5, wherein said Cas9 domain comprises a Cas9 nickase (nCas9 ).

8. The base editor of claim 2, wherein said base editor further comprises an inhibitor of nucleic acid repair.

9. The base editor of claim 8, wherein said inhibitor of nucleic acid repair is an inhibitor of base excision repair.

10. The base editor of claim 8, wherein said inhibitor of nucleic acid repair comprises a protein that binds inosine.

11. The base editor of claim 8, wherein said inhibitor of nucleic acid repair comprises a catalytically inactive inosine-specific nuclease.

12. The base editor of claim 11, wherein said catalytically inactive inosine-specific nuclease comprises the amino acid sequence set forth in SEQ ID NO: 32 or SEQ ID NO: 33.

13. A method for editing a nucleobase of a DNA sequence, the method comprising:
(a) contacting said DNA sequence with the adenosine deaminase of claim 1; and
(b) converting a first nucleobase of said DNA sequence to a second nucleobase.

14. The method of claim 13, wherein said first nucleobase is adenine.

15. The method of claim 13, wherein said second nucleobase is inosine.

16. The method of claim 13, wherein a third nucleobase complementary to said first nucleobase is replaced by a fourth nucleobase complementary to said second nucleobase.

17. The method of claim 13, further comprising replacing said second nucleobase with a fifth nucleobase that is complementary to said fourth nucleobase.

18. The method of claim 17, wherein said fifth nucleobase is guanine.

19. The adenosine deaminase of claim 1, wherein said adenosine deaminase comprises the amino acid sequence of SEQ ID NO: 1 with the exception of the one or more substitutions at positions selected from the group consisting of amino acid residues corresponding to positions 8, 17, 18, 23, 34, 36, 45, 48, 51, 56, 59, 84, 85, 94, 95, 102, 104, 106, 107, 108, 110, 118, 123, 127, 138, 142, 146, 147, 149, 151, 152, 153, 154, 155, 156, and 157 of the amino acid sequence of SEQ ID NO: 1.

20. The base editor of claim 2, wherein said adenosine deaminase comprises the amino acid sequence of SEQ ID NO: 1 with the exception of the one or more substitutions at positions selected from the group consisting of amino acid residues corresponding to positions 8, 17, 18, 23, 34, 36, 45, 48, 51, 56, 59, 84, 85, 94, 95, 102, 104, 106, 107, 108, 110, 118, 123, 127, 138, 142, 146, 147, 149, 151, 152, 153, 154, 155, 156, and 157 of the amino acid sequence of SEQ ID NO: 1.

21. The method of claim 13, wherein said adenosine deaminase comprises the amino acid sequence of SEQ ID NO: 1 with the exception of the one or more substitutions at positions selected from the group consisting of amino acid residues corresponding to positions 8, 17, 18, 23, 34, 36, 45, 48, 51, 56, 59, 84, 85, 94, 95, 102, 104, 106, 107, 108, 110, 118, 123, 127, 138, 142, 146, 147, 149, 151, 152, 153, 154, 155, 156, and 157 of the amino acid sequence of SEQ ID NO: 1.

22. The adenosine deaminase of claim 1, wherein said one or more substitutions are at positions selected from the group consisting of amino acid residues corresponding to positions 23, 36, 48, 51, 84, 106, 108, 123, 142, 146, 147, 152, 155, 156, and 157 of the amino acid sequence of SEQ ID NO: 1.

23. The adenosine deaminase of claim 22, wherein said one or more substitutions are substitutions selected from the group consisting of W23R, W23L, H36L, P48S, P48A, R51L, L84F, A106V, D108N, H123Y, A142N, S146C, D147Y, R152P, E155V, I156F, and K157N of the amino acid sequence of SEQ ID NO: 1.

24. The adenosine deaminase of claim 22, wherein said one or more substitutions comprise a group of substitutions at positions selected from the group of substitutions at positions consisting of:
(i) W23, H36, P48, R51, L84, A106, D108, H123, A142, S146, D147, R152, E155, I156, and K157;
(ii) W23, H36, P48, R51, L84, A106, D108, H123, S146, D147, R152, E155, I156, and K157;
(iii) H36, P48, R51, L84, A106, D108, H123, A142, S146, D147, E155, I156, and K157;
(iv) H36, P48, R51, L84, A106, D108, H123, S146, D147, E155, I156, and K157;
(v) H36, R51, L84, A106, D108, H123, S146, D147, E155, I156, and K157;
(vi) L84, A106, D108, H123, D147, E155, and I156;
(vii) A106, D108, D147, and E155;
(viii) A106, and D108; and
(ix) D108; of the amino acid sequence of SEQ ID NO: 1.

25. The adenosine deaminase of claim 22, wherein said one or more substitutions comprise a group of substitutions selected from the groups of substitutions consisting of:
(i) W23L, H36L, P48A, R51L, L84F, A106V, D108N, H123Y, A142N, S146C, D147Y, R152P, E155V, I156F, and K157N;
(ii) W23R, H36L, P48A, R51L, L84F, A106V, D108N, H123Y, S146C, D147Y, R152P, E155V, I156F, and K157N;
(iii) H36L, P48S, R51L, L84F, A106V, D108N, H123Y, A142N, S146C, D147Y, E155V, I156F, and K157N;
(iv) H36L, P48S, R51L, L84F, A106V, D108N, H123Y, S146C, D147Y, E155V,I156F, and K157N;
(v) H36L, R51L, L84F, A106V, D108N, H123Y, S146C, D147Y, E155V, I156F, and K157N;
(vi) L84F, A106V, D108N, H123Y, D147Y, E155V, and 156F;
(vii) A106V, D108N, D147Y, and E155V;
(viii) A106V, and D108N; and
(ix) D108N; of the amino acid sequence of SEQ ID NO: 1.

26. The base editor of claim 2 further comprising a second adenosine deaminase.

27. The base editor of claim 26, wherein said second adenosine deaminase is a TadA adenosine deaminase.

28. The base editor of claim 26, wherein said second adenosine deaminase comprises an amino acid sequence that is at least 90% identical to the amino acid sequence of SEQ ID NO: 1.

29. The base editor of claim 26, wherein said second adenosine deaminase comprises the amino acid sequence of SEQ ID NO: 1.

30. The adenosine deaminase as in any one of claims 1, 19, and 22-25, wherein said at least 90% amino acid sequence identity is based on an alignment against SEQ ID NO: 1, 8, 9, 371, 372, 373, 374, or 375 by NCBI Constraint-based Multiple Alignment Tool (COBALT), and wherein said COBALT is used with the following parameters:

alignment parameters: Gap penalties-11,-1 and End-Gap penalties-5,-1, CDD Parameters: Use RPS BLAST on; Blast E-value 0.003; Find Conserved columns and Recompute on, and Query Clustering Parameters: Use query clusters on; Word Size 4; Max cluster distance 0.8; Alphabet Regular.

31. The base editor as in any one of claims 2-12, 20, and 26-29, wherein said at least 90% amino acid sequence identity is based on an alignment against SEQ ID NO: 1, 8, 9, 371, 372, 373, 374, or 375 by NCBI Constraint-based Multiple Alignment Tool (COBALT), and wherein said COBALT is used with the following parameters:

alignment parameters: Gap penalties-11,-1 and End-Gap penalties-5,-1, CDD Parameters: Use RPS BLAST on; Blast E-value 0.003; Find Conserved columns and Recompute on, and Query Clustering Parameters: Use query clusters on; Word Size 4; Max cluster distance 0.8; Alphabet Regular.

32. The method as in any one of claims 13-18, and 21, wherein said at least 90% amino acid sequence identity is based on an alignment against SEQ ID NO: 1, 8, 9, 371, 372, 373, 374, or 375 by NCBI Constraint-based Multiple Alignment Tool (COBALT), and wherein said COBALT is used with the following parameters:

alignment parameters: Gap penalties-11,-1 and End-Gap penalties-5,-1, CDD Parameters: Use RPS BLAST on; Blast E-value 0.003; Find Conserved columns and Recompute on, and Query Clustering Parameters: Use query clusters on; Word Size 4; Max cluster distance 0.8; Alphabet Regular.

* * * * *